United States Patent 7,960,114 (GENE SIGNATURE OF EARLY HYPOXIA TO PREDICT PATIENT SURVIVAL (75) Inventors: Renaud G. Seigneuric, Crimolois (FR); Maud H. W. Starmans, Heerlen (NL); Glenn Fung, Madison, WI (US); Balaji Krishnapuram, King of Prussia, PA (US); Dimitry S. A. Nuyten, Branford, CT (US); Arie van Erk, Eindhoven (NL); Mic) - sequence listing, part 4

SEQ ID NO: 170 - DNA, 71470 bp, Homo sapiens
gctttttataactatgatgccagaggagcggatgaactttctttacagatcggagacactgtgcacatcttagaaacatatgaaggtgcgtatgcatcttggtatcttttctcttacattttgggcagatggcacaccttctcagtgcctgctgggcaaagcattcctctgttacagacacataagacagtcatgcttccttctcaggctcccttttcttgcagatggatactgtttcaggtaagggtagtagtgaggctgttgtttaatactttctgaaggtgaacttaaaactgaaattcccatttttaaactccttggctccttattttcaagcatgtgtaaatcttttttttttttttccttttgagacagagtcttgctctgtcgcacaggctggagtgaggtggtgtaatctcagctcactgcaacctctgcctcccaggtacaagtgactctcatgctttagcctcccgagtagctgggattacaggtgcccgccaccatgcctggcaaatttttttgtatttttagtagagactgcatttcaccctgttggtcaggctggtctcgaactcctgacctcaaatgatctgcccacctcagcctcccaaagtactgggattacaggtgtggtccactctgcctggccaagtgtgtataaatcttgattgttaacagttgaccacttgataaaaaataggtttaagatagtttacttcgttgttttgagacagggtcttgctccatcgtgcaggttggagtgcagtggcacaatcagagctcaccgcaggcagcctccccatcttgggctcaagcagtcttgccacctcaggctcccaagtagctgggactacaggtgcatgctgccacactcagctaattatttatattttttgtagagacaggatttcaccatgttgcccaggctggtcctgaactcctgagctcaagtgatttgcctgcctcagcctctcagaatgctggaattacaggcgtgagccactgtgcctagcctgcttcattgttttgatgtgtttgatgtgaactaagatttcttcttttaatgtcctcacttagatttgttagcagtatatgtctcagaggaaccccaattttcatcctttcctttttttttaaacctgtaatccccattttcttgggatgaacagagatttatcatagttatatgggatgccgtccaatgaagcaatatttttttttgttttttttgagacggagttttgctcttgttgcccaggctggagtgcaatggcgcgattttggcccaccacagcctctgcctcccaggttcaagcgattctcctgcctcagcctcctgagtagctgggattacaggcatgtgtcactgtacccacctaattttgtatttttagtagtgacggggtttctccttgttggtcaggctggtcttgaactcccaacctcaggtgatttgcccgcctcggcctcccaaagtgctaggattacaggcatgagccaccgtgcccgtcctgaagcaattgttataattatccaataaataaactattggtgacagtggttttccaatgtccttggcttttcagacaatttgtttttatattttgtgtttgcaaataatttgagcatgccatatttcattttatgctgtggttattgttgcacagaagggaagaaatgatgggcttgattttttaaagactgttcagatctggaggttttggtgagattgtgttttcttattgttgtcggcttaatttcctgcttgaaagggtggttcccatatagcatatgaataaaaaggataatttcagtagaaaaactgctttttcacagaggttttttagcaaaacccttccacatgggaggttgggggtgagaggggaaattgaagacatcccgtagtaatcagcaaattgaacttccaacttgaaatccactttacaaggaatgaagtatgcccagcttcctgctcgaggcaaactgtgaccagctcctggtagactcctctgagaaacacagacctactaacagatccatgttcatggcccttatttccccatctgatgcatgctgtaccttccctaaaaaagtcctgtctgaaaaaaaaaatcgactttagtggcctctgcgtggaagccagtgcagctctgcaaaaaccagccccagtccttaagcggatgagtagttgtgatggggtcttctgcttgttttccgtgtttacagctgacagctgtgttcccttatctcctctcagtatatactgcatgtgtctgagaggagacagagagaaattaagtagaggttaaggatcaaaccgctcatctcagacacttttctgatttgaagggaaatgctcttgtatcttgttttacttttgctgccggtcagttgaagttgaaatcctggttaataaacactgggcaatgatgtcattcctgaatagttaatgatttcctgtggcccctgggcctgtggagactgcatttttgttctttgcttcataagaggaatgcgtgtgtggtggtggtttttttttttttgagatggaggctcgctctgtcgcccgggctggagtatggtggtgcaatttcagctcactgcaacctctgcctcctgggttcaagggattctcctgcctcagcatcctgagtacctgggattgcaggtgcccaccaccatgcccagctgaggaatgtgttttttaaacagtggactcctcgggcatgtcagtggtccttgtaatacgtgtaacttcaaaaatatctgattgcaggcatttgactttttggctgacatcatgataagagatctacagtgaacattaattttctgggctagtcattctttctagattctgatgaaaatatttcagtctttgtaaagactctttagcataaaatgaatttccgttccttgacaactaactttttggttttaatctgaatctaatcagagaaatgcatttggagaagtattaatagttttgactttggggagtgtggtgactttttgtcattaaataaaaagagaataatgtacttccatttgttttccaatatcttcctcttgttttatctaaatttcatggcttgtattagagtctggcattttctttttctttccttggctctccttttcctctaagatgactttttggtttagcaagtttgattttctttttttctatgatcctttccaggatattacagagcttgctccagaggctataatttctagatgataaatctttattttagggttcaaagactaaatttaccttcaagttgtggttaatttctctttcttgagctcacgaaggcttacagcatagaacaaagaaaatgagctttctagctcatggtggaagtggaaagagctttgagagctcattcgtgcagacccctgcctttaaacaatgtcctacctccagataggagaggtgaggccaggccccagtgttgattgagtgactcttgtctggtcaagggcgtgccaatcctgctgtcgactcgtttccatagggtccccagggcttccatagcgtccccagggtgagatgctgcaccagaggcaagctgcaggcattgcccaaagttgaggaaattgtccttttgattcagccacattcaaacttaatttattcaactctttaaaagggatagtgatgcattttcttctaaaatgactagaccgccattttcctgtgctggactgtgtcctccccgagtttgggacctgtgtcttgcctgtatttgcctgttccctgggtggatgtctctttttttggagcaggttggttgactacgtggaggccacttgcaagccgtgccagggagaagttaattctgtaacagctgtgaatctttctccttccagcctcatcccctctttgctgtgccccagagcagccaggtaatcgttccgttctgttctcttactctccggtgcaaaacctctgccgggacatcctctctccttcatgccgaactctgtcatgcagcagggtttgtggtgtgacccctacttgtcttagggcacttccagtttctgagctcatggaggacagagattgggtctaatctctttctgtatttgtggcacccagtgtggtctctggtacatggtgtgcgggctcactttgttgaagaaatagtgcatgccaaaaatcgtggggaggaaaaccatggttttcattttgcttaggaaggccattagaagaggaatcgactgcctatgaacattaaataaagacacaaaactccttgcctttcatgcctactgcttggcccttcctcctcctgcctcccatagaaaacctttctactgtgtgtgaagtggcctctcgtttgcctgtgttctcgtgctgtttggtgtgcatctgtttttaacagatgtaagtgtgtcattatagtcttgttctgttttttattttccctcgtgctccatttaaaatgcactgtgttctctgtgtccctttagtccatggctctaactgcatcgtgtgcacatttcatgttttactaactgcctgcctccccgggtatgagcacttaggttgtccccgcttcccaccacccaagatcaagctgccctgagcatcccatgtccatctcactctgcagggcacacagatgtctttgggctgcgttcccaggagggggttgctgggtcttgggtgtggagatgtagactttggataagcagggcctgcttctcccaggctggttgccgcagtggacactgccacccacggtgaccaggggcttcctgcatcctgcagtgttctgccttctaccactcttaactgtgtacttttcatttctctgactattattaaactgaagcatctcttcatacatgttgaggtcttatgggtttcttctatacatagtttataaactttgctcattttctttcttttcttttttttttttttgagatggagtcttgctctattgcccaggctggagtgcagtggcatgatctcagctcactgcaacctctgcctccctggttcaggtgattctcagcttcccgagtacctggtattacaggtgcacgccaccacgcccagccaatttttttttttttagtagagacggggttttgccatgttggccaggctagtcttggaactccagacctcaagttatctgccctcttcggctgcccaaaataccaggatgacaggagtaagccaccactcttggcctcattttcttactatacttagttgctgtctttttgtgtctctgtattatttccttatgtattctaagacgttaatctttgtcagtttcagaaaagaaaggacatattaatgttgaaaatgcaggaagactataataggataaaggacagttgttgaaactgagtacacagctttgcataactcattcaactgacctttctttttcctttttgatatatgagcactgtgtcatagatgggctttgatatatgagcactgtgtcatagatgggcgctgatactgggccagcttatcaaaaccactgaacttgacaatatggctatcaggagataatccttcaaatgtgtggctgaagtctaggcattttgtatctgaggttcccccaatcagtctgttgagtctccagtcaagagagtgaaatgagttcagttcatcataactgggtcttagcaaaacctttgccagagtcctggcagtttctgtcctcttttctggatatgcagaaaacagctggttagtcatcccttggggattctgctcatcttaacaccatcactttctggttcacaatcatccttttcatccctggttgtgaaaattttcaccttttgagagaggtggaggccagttgctgtgacaatggcccgttttcacatctgtctgatctttggttctgaggtttgcctttttaatagtgtaaagaaacccagtatttggttattctctgggaatttacccagctcacgttttccaagtgccctctgtcactctctgacagggtcctttgttcctatggggcagagttgggatttgtctttaagctttttttttttgagatagagtcttgctctctcatccaggctggagtgcagtggcatgatcttagctcactgcaacctctgcctctcgggtttaagcaattctcctgcctcagcctcctgagtagctgtgatcataggggcttaccaccatgcttggctaatttttgtattttttattagagatgggctttcaccatgttggccaggctggtcttgaactcctgacctcaagtgatccacctgccttggcctcccaaaatgccaggattataggcgtgagccactgtgcctggcctctttgagcttttgattagctttccagaaactagatggcctggagtgacttcagaatgtttgggagtaaaaaatcatccatctgaactcacaaatggtggggtgcttggaggctggatactgacggtagacccctaggcctttgcaggggcagttcctgtcctcagcctgagaggggtgccaggggtgtggctgggtctggtcccttgttgaagggactcttctgtgtggcatccatggcatgcggatggttcgagtgtgtctttctttctgctctcactattttctttctctcgccacttggaaggagcgagaagtggagcctgggccaaacccaaagggcaggtgtgtcctgtgcttggccctggagcttcctgtgggttgagggctgtattgttgctacagaagtactttgtgaggtcgtggctgctccaggaaaaagtgccctgtcttgaagtgggaggaagttctctctcaatgggttttctgttttggggcagcgagatgctgacatgtgcccttggagagatcttggtctaaatcaggcagagggagagtgaagaaaatgcatacacaaggagcctactcagggccagtggttgaaaggacaagtcctgctcttggaactgtgcatctgaacttcaaactgctgcttccgaaccacatgagatgacggaggtgaaggtatggaggcccatgtgtgaaggttgccagctgggctccgggtgcgctgttgaaatgctctctgggaaaccacgtagtatatctccaaagccttaggttcactgaaaaatgctggtgacaaactgacctcactggttctgccaaacagtgagttctacacatcatgaatgtattgtgaggaccctaacatgtctctttgtactaactgtttcaactttgtgtttgtttagggtggtaccgaggttacacgttacgaaaaaagtctaagaaggtaagtccttcttcttaaacacagtgcatgtctcttcataaatcacaccttgagaggaaatcaattccatctcatttgtgtctgagggttttacttctatatctctttctctgaatttaaaaaaatatatgggtaggaatgtgaacgagcttggattgttttcttctgaacaatatgtgtacatagaaattgtagcttcatctccgtgagtgaattgctagtttgtgatatagtgttggcctgttgtcttctgttcatgaattttgtgtcctttttaggtctgtgtgtgtcagagaatgatccgagtaaagcgacttcaggaaaaaaattatttctcacagttgtcaatcttatgttgtccttaataatagattagcaaatttgcaagctcatgcatgctgtttccctcttgcatataactgtttttactctgcctaagtcaagctgtgaaaaaaggagttctgctctcctagagcagtttgcatgagtggttgtttgaatttctgaaactaagacatgtaattacacctcggatcattgtggtgggcactcccatacacaattctgttgtggctttaacattcttagcttcatggaacctaattatggctcttctgtttcattctacgatgttaagattttgaagtaacctctattctaagctgtggttgggctgtccacgttacccaatatgttttaatatctaattatgtttgacccgatgtgttttaatatctaattatgtttgacggatggttcattttacttttgtgtcctaaatttacctctcattatctccttattgggctggactctggattgtggtcctgagcctgtaataagtcctccaaagtctagtggcccaagtgccagggtccttccactctgccttccccagagcccctaacccaggctttgctgagcaggtcagaatgggtcatcctctcgcaacaccagcacttgggaaggatccagggtggtccctatggcagccatcctctggcacagtcatgtctaatgtgagagacagtgttaggaaatcagtgagccagatctgcaaattgggaccaggacctcttacctccaccttgccaacctcagactgggctacaggtctctacacatcagtgacctatagccttgaagtttgcacaagatcgatttcaatccagtggatggtggaatagatttctccaaggaaagttctattttcacattggttttcccttccccaatcaagagtgaattccagccaggcccaaagatatgcacctgtaggcccagctacttgagagactgaagtgggaggattgcttgagctcaggagattgagaccagcctctgctggtcataatgagtgagatctatccctaaaaaaatagtgtgtatctgcagatgaagctctgaatttaggaaagctgcagttgaaacctttagtaataagagattaagatcatggactaatatgcccctcccccatcacattcctacataggacacaactgccacatcctgggctggatgtgccccaggcaagctgttcctttttctttgaatcttacttggtatttgttatcaccttccccaatttgagatctcttccattcccacaatgcctcctgaaaccacagtatttctgcactacacctgggcacctagacatcataactcattcataactcatcaacacagtagcgctgggtagggcatagctatttttccatctaagatctccactggtagatgaataaatccaagctttacagagattataaatttgtaaggggcctcctaggcagtagcagaaaagggatgtgggccctaggaatcctggcaccacgtgtctgtaaacaactttcctgtagttataagtgtgcagttgattggggtggtgctgagcaggcccagcggaagttgcgcatttcaaacctgcaggtgtgtccagcctcactcagtcattatccttcctgtggcttcatgattctccagtgggtttgctgagattgagggttgtctccacctgtggacatggacaagactgggactggttttttgtttttctcccccatctgggtggacacctattgctatcatggaaagaaacccaggagggtgtacctgggatttggaggtgtcccggataaccaggacctgaacacagcaacccagcgttgggtcccttcagacttctgttttttttaagttaatgttttatttttttggagacagggtctcactttgtggctcagactgagtgcggtggcacgatcatagatcactgccaccgcgacttcctgggctcaaggtattctcctccctcagcctcccaagtagctgggactacaggtgcacaccaccatgcctaactaatttgtaaaaaaaatttcggcagtgaaagggtctcaccatcttgccctggctgttggtgagctcctaggctcctaggctgaagtgatcctctcaccttggcttcccgaagtgccggttgcaggtgtgcacctctgagcctggcccagccttgtttgttgctcagcctctgactctctgcctgacgccttccctctctgtgataattcttctttatatggaatttggccactttccttgttggcagaagcaacatgaatcattggtgcctgctagaccagttcagccccctgcctgccccctgcccaccccctgcccttcccaaacttgattagtagcttgttttctgcatcattcagggctgaatgccggggaaacccatgcagaagcttccattcccacaacaggtgccttgaagccacaggggtgccactttatcaatttctgctgcatgcactaaatctcatgcaggaagcggtagctgggctgcgttgcactgcccaagaccccaaccccgttgcctcttttcttacctttgctttattccagtaagggagttattttgcttgctcagaaagcaggaccctacgtttttttttttttttttcctgaggcggagtctcgctctgtcgcccaggctggagcgcagtggcgggatctctgctcactgcaacctccacttcccgggttcaagcgattctcctgcctcagcctcctgagtagctgggactacaggtgcccgccaccacacccggctaatttttgtatttttagtagagatggggtttcaccatgttggccaggctggtcttgaactcctgacctcaggtgatccacacacctgagcctcccaaagtgctgggattacatcgtgcctggcctcggacccaaactcttgataaagctctttctggcacttcacagaatgtgcctgaggctgaatgtcctgttgagaaactctccccaggcttcattctcttgggctcacatgtgcattgcacttgagggaggccgaccagcttatcagcggaagctagggtgtacccccaggtgttgtgcagattgggcgaaattcggcctgtctttctgtattttaccagagggcccccctgttggggaagtctctgagaaagtctctgtgggtctgggtacgtggtcagtgcacaagggacaattggtggtgtaaaccaactttcatcattttgaaagaggagaccatcatcaaaaattgcttttgagacatcagttggcctttgttctgcctgcattgaggccaaaaaggtgtgatctatggagcagcctgcaaattgcctgtatctttgtggactttttcctttgcaagtgtgttgcctgtttgcttctaagacatcggcagactgcaatacaagccaaatgagttgccgtcttttctacttctttgtgttttctttgatatgttaagacttaaaaaattaagagcgatctagccacccctcaccccacctttttgggaactattgtttgatttacattcagcaatcctattgataataaaagctactgttttttttttcctcccaaagggtatatttcctgcttcatatattcatcttaaagaagcgatagttgaaggaaaagggtgagtctggtcttgatgtttaaatgaagaattgcaagtactatatttggccttgctgctcttttgtacgatggcgtaatatgagagggtcaagacaatgggtgtgattgactcctgggggacaggagttttggggagagaaaggggacttgtgattcagagttgtgtttaacatggcttttatcctttatggagtctgaagtcagcaccatacttggcagttactgtccttgaacctggggtcactattggaaagcattcgccctggtgctctgtgcttcctctgtgagctactgacttcatttggcagagactccaaagccccccagctctgagtccccttttttttgggaagacattgcaggctgtgatataaatggagtttagggtgaagcaacagttgttaaattgggacatgcaggagtttacattttgtctaattgtgatgtatgtttcctagaggtcataaaactgatgtataagatcattaaaaggacatttctagaacaggaacccattaggcaggaatggcagatgaataaccaggtgtgaacttggaagaaggaacattaaaatgttttctttttttgtctctgctacatcttcacactcagttaaatatgtaaattataaaattactaatcatatgattactgcataatgacatctctttggctgattacaaaattgcctttccaagcactgtacttttaacatatgaaaagaaccgttcgggttccatagttccatgatgcatacttaaaatgaagaaaataatttagaggcatgaatgatgatgacctgcaatatggtactttttagacagataaagtgttttgtatgcaaagttttaaagggaagaaaaagaaagttgagacttttactctgtggaagtaactggatcaagtgtgcatttagtgtactttatatctgcattagaatccttatacagggcagactgtgtatgattatttaaaaagcactttgatgtatacaaaagaatatatgtaaaatgtaattatgaagcatgataataaagtgaacaacaggttattctgagtctcaataagtagagtcacacctaaccagacaggcagacagagacacatttggttcctgttcctgggccttctggtccaaggtgccccactgtgggcaaatgcatagagctatggtgaaatgaacagtttagaaacaatttccctgcctttgctttgggttccctgtgattgttctccacactgttttcctggctctatctgtctcccttgccacggccactcaagcctagctgcccaacagctccttccctgaagaaccccggccttcaggcttgacaggtgatctcatccctcttcttttcctccaggttgttgtagacttccaccttcccttcttctcctggtcctttcccctttctagtgccaatgtgggccacgctttcatcccacctctgcctgccttcttgctctccaagtttattgtcctgtctctcttgcagagtctgtctctttcaggatctgtctcttgctggtctcttgcatgatcgttctcatatggcctctgtcttgcaggctgccttgtaagcctctctttcttgcatgagctctctcttgcatgatctgtctcttgcaggctctgtctttctcttgcaggctctgtctttcttttacaggctctgtctttctcttgcaaggctctctctcatgtgatctctctcacagtatcttgcttgcattgactctcgtgaaggatctcttttgctttgtctctcttctctctggacgctgacttcattcattctcagacatcccaaatgattactctatgcctgttaccactgattctgtacctattcccccataaccaaagcaattcccattttgtcctccatgcttttcccagtactgacatggttagcaatgcctccttatgtctggacctcacagtgtcttctcatcctctgcctctggagctccactgcagccttggacacgttggtccttgcttcactgaaagcccctcttaacgccgatgctcttatcctcttcttattatgctgacctactgctcaggcatgtcaccgtctcctctgtcctgtgtccgctactctgagggtgctgtcctagccttctcctatttctttgttgcccctccctgattgacatggcctctgttgcgtttccctcttcagctgatctgtctctgtgggtgatgctcacatcgggaccaccagccctgatttgtctcttgacccctcattcagttaggcagccaagtaactaatgagaatcatccccactgttgggtgagcatctgctatgtcccattcattctcttttcaaaaaaaattattattatttttattttgtattgtgtatttttattttatgagatggagtcttgctctgtcacccaggttgaagtgcagtggcgagatcttggctcactgcaacctctgcctccaggttcaagtgattctcctgccttagcctccccagtggctgggactacaggcattcaccaccatgcccagctaatttttgtgtgtgtgtgtgtgtgttttttttttttcagtagagatggggtttcaccatggtggccaggctggtcttgaacttctgaccttaagtgatctgcctgccttggcctcccaaagtgctgggattacagatgtgagccaccgcacccggccaaaaaattatttttagatttgacaaataaaaattgtatgtatttatggtgtgcaacatgatgttttgaagtatgtatacattgtgggatggctaaatcaaactatgtgtgcattaccttacatacttatcatttgtttgtagtgagaacacttaaaatctactctcagcaatttcgagtatacaatacatagctattgtagtcaccttggtgtaggataggaggcctgttgaacttattccttctgtctaacagaaactcggtgtccctttgacccatcatctccccactcccctatgtcccattcttttttttttttttttttttttttgagacgaagtcttgctctgtcgcccaggctggagtgcagtagcatgatctccgctcactgcaacctctgcctcctgcgttcaagcgattctcctgtctcagcctcccaagtagctgggattacaggcgcacgccaccatgcctggctaatttttgtatttttagtagagacagggtttcaccacgttggccaagctggctttgaacccctgacctcacgtgctctacccgctttagcctcccgaagtgttgtgattacaggcgtgagccaccgcgtggagccccattcattcttaaagatgctctgccttgatgcactttccctcagtcttaccagcagccctatgaggcaggcattattggggttacatattcttgaacactggcaggtaacaaggtggtaacaaaggtaagacaataaagccagatcaaatgtgttaatgccagctggcacattaatcccagggatccactgggcctaccagaagggaggaacctaaggtggaaccagaaccaacagcaggacatggtgcatgcactgaggccctattcacatggtggaagggaggtcgttgagctccaggcttctcatagccagtgtgaggagcaccagtgcactcaacccaggatccgtaagatgaaaacagcccagtcgttgttgcagatcctcatactgtgagtggaaggaaatttctccctgcagactttatagggatgacaccgtagcatgtaatgaaccgcatttccatcagcatccttactgggaaacttggggacatccttggcagggctgttttaatagtcatgttcttcagtagacactgatggtggcccatgaaagggtcattttgttgttgttgtttttgagatggtgtctcgctttgttgcccaggctggagtgcaatggtacaatcttggctcactgcaacttccgtctcccgggttcaagtgattctcctgcttcagcctcctgagtagctgggattacaggcccgcaccaccatgcccggctgattttttgtatttatttatttttagtagagacggggtttcaccatgttggccaggctggtctcgaactcctgatccacccacctcggcctcccaaagtgctgagattacaggcgtgagccaccacacccagcccaaagggtcattcttcatagcagttttctaggggatggttttgcctgcacccttccctctgatgtctggttctggaactatccatgagaccaccgttcttccagggtccccgttgtctgttgctttgggatcctcccctccactgtcaataagtcatcacaggcctgatctccaatcgtgagccagtcagggttccttccacaggtctgggctctgtgcacatcaagggttgtaggtgggaactattgtagcatccctcggcatcccatgctggccacattcttgcctgttcaggacacacagacaacctgtggggccagctagcctaactacaccagccacaaattcactctctccccctaaccctcagtagtctgagtcttacttagcatagtgcctgacccagagcacatgcccaggaagcagtggttgatttgatgaaaacgagcgcataaataggtaatgagttaagaataagtcaaggggctgggcgcggtggctcatgcctgtaatcccagcactttgggaggctgaggtgggagtatcacctgaagtcaggcgttcaagaccagcctggccaatatggtgaaacctcatctctactaaaaatacaaaaattagccgggcatggtggtgggcacctgtagtcccagctgcttgggaggctgaagcaggagaatcgcttgaacctgggaggcagagattgcagtgagccgagattgcaccactgcactccagcctgtgtgacagagcgagacaccgtttcaaaaaagaagagtaagtcaaaggttaaacttttggggcggaggaaaaaggataagaaagaggatacagagtttaatcagagttggcatcagatagagtaaccatggacatttggaagctgtaacctctctcatatttcgccaaggataactgcttcctgtattatcatgtaatgagttttatgcgtgatggaaaatgtaaaagtaatcttaacccaaacctgcattttaatgccacatggaccggctgtaatttatggcatctttaagatagatgggtacacatattatgaatatactttccttttgccagaccttgacattctgtagacttttaatggaatattatttgcctctttcatcttactttgacgtatgaggtggatggcttacgtgcagggtaatgtatgaaccttcccaagctctgtacaaatataacttgtcattcgtagagacgtatgtatttatatgtgtgcatgcagtcttatttgtagattttcttcccatttgcttaatactgaacgctatggcctagatgtgaaatttaccaggtactactcatagcaggcagtgaaaccgtggactcagctgctctttccttctttcctcccaggcaacatgaaacagtcatcccgggtgacctccccctcatccaggaagtcaccacgacactccgagagtggtccaccatctggaggcagctctacgtggtgagaaaatgagatattcattcaaagcttagaaatagagagtgggcttttttgaccctgatatgccaatgggatgtttttttttctcagcgaaacttaaaagcagagcttccgagacagagttttactcggaattggcaaaggaagcgacatggctgagagtttagcccctgctgggggctgtgtgcccttcgacctgccatgtatttgggtgtattacagtgagctgtagcagaagggactgtaggatgtgtctttccttgcattggaaggagaaatgtggttgtttcaggcccctggaatgcaggatcgggcagtgggtgttgatgtcaccttttaaacagtaataggtgcttatttaaggatccggtagagggcaattactatttttttttttttttttgccgttgtctgacagtaggtaatacctcttatcatttaagaaaaacaacagtcttctagatttacctgtgtttgtgacaggaatagggaaatattttacattctagcttcgtgtgcaattgtccagttctcctgatcacagaagaagtcttattaatgcagagaggttgaagctctgacatcttccatttcgtattccctcggggcatttctttgcacataaattcatatttgcagtagattaccttttgttaagcttgtatttctattcagagtgttgatttctcatatgctaatgttattaccaccaagccagggctctggaaggaagtcggtacgttcatttcttgagaacatagaaaacttcctaaagtcctgcagctgcttgttgggcaggcttgttgtttttgattatacagtggtttcctataaatgcacagtaataagcagttgcagtaattgtcatcaaacgtactgaaaaacctaaaagcgtaaagttagccatgaatgttttgtgtaaatctgagcaattctgtagtcagggtttcatcttcaacttagcaatttttaaacaaaaatatggcaacaaaacaaacaggagttgatgctcatagtcagtggacctacttaagtctgtaaccctagagtaggtattcttaatgagcaccttggtttccttttacaaaacttaaatttgcctctgatagacttacatggttggatttgtgcaaagaaagctaacccccaaaatggctataatatttttatatgggctgggcgcagtggcttatgcctgtaatcccagcacttagggaggccgaggcggatggatcacttgaggtgaggagtttgagaccagcccggccaacatggtgaaaccccgtccctactaaaaatacaaaaattagctgagcatggtggagcatgcctgtagtcccagctacttgggaagcttaggcaggagaattgcttgatcctggaaggcggaggttgcaatgagccaagattgcgccactgcactccagcctgagtaacagagcgagaccccttctcaaaaaaaaaaaaaaaatgcatttttttgctgcacattgtagatattagcaaaatagtaaggattttagatagttgatacagccttagagcagtggacaagagaaggcagcgtggatattagaaactcctagaaagaaggttaaataccagagtgagctcagtacgtggtttagatatgtagagggggagttttttaaaaaagtggcagtgaacaaatttaatgttttaaagggaccatgacatttagatacctttttatttatttattttttgagatagggtcttgctctgttgcccaggctagattgcagtggcatgatcacagctccctgcagtcttaacctcccaggctcaagcaatgctcccacctcagcctcctgagtagctgggactacacctgtgagccaccatgctcagctaatttttttaatttttgaagagatgaggtctccttatgttgcccaggctgatctccaactcctggactcaagcaatcctcccgcctctgcttcccaaagtgctaggattataggccggagctaccaaggccagcatgcttagagttttatcacattaggttccacctaaatttcttttcatggaaagaaccactgagttattttccttcagataatccctaatctccttgattattgtacgcttgtaattgcaagctgcaaactgttgcttttctttgaaccgtcaatcccatcaaaattcttagaaagtggtaagaagtgtgagttttgcatcttatttgcattttcctcttgtcacaaagcaccaagagcttgtagattgagatttggcctcttgcagaagtgtctcttgtgggttgtacacaccacagtgtgcagcagcccgcccagggtggaatgcttcttcttccctatagctgagctgagagcgaggccgaggagttcaggttctcagtgtgctgagaagggtccagggtgcagggtgttctgaagaccgtatgtaggttgtaggattcagatctttaggctcagactaattccggaggagctttagacttgcccatctctgatccagatgcaggaagctcacgagcaggtgttgacgctcaaggtctagcccctgttgggatcacctttttgcttcagtgggacacaggatgttggatgaagtcttggggattatgcattactttttgttcctttaatcttttaatgtcgcatggaaaccaaattccgtataatatgttttagtttatgctgaaagcaccttttaattcaacattaactaaatctcatgatctagtgcttatacctcatgcgtatttgaagagatagccattctctaccatctccacaatgctgttttataacaaaatctttctgattgggtttttccccgtatagcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacaggtttgtttatttgaaagatgattttacgcttaaattatccaatgtaataacatcactataagtcttcaggagaccaagatcatattttatcataaaacaaaatttctaccatcaaagtaatggcatgtttttcattttgaaaaggatgaggtattttccactggattctgaactggggaattttgtgagccattcttgaaaccttgtcattcttcaagggatagagtcaagaagccagggagcctgtcattttcaccgttctggagggaaccccatcattactcccctagcaaggaacttttactttctgaccatagtttttgactttgagtccagatctggggggccttgcatagtgacaagcaacaggtttctttctgtggaatcccaggttctgagcattggagtggacattagatcactggaaagtttgtcacctgtgtaggcttgccagttttcacaaacagaaatacagcccagttaaatttcactgcagataaacaacaaatagttgctttgtgcagttatgtctcttgccagagcaagagttcttcccatccatagcaggcatccccccagctctgcatgagtgcctttagtgctcacccctgcctacagctgtaccttctatgttagcacgtgttttttgatgctgaaagcaaacaagctgctctgatcctaattctgctgggtcctgtaactagaatgaggccatgcccttttccacctggtaatatttagttttcatagaatagcagagctgcaagaagccttaaaaagtatctggtcacatggttcccaaatgctcttctatttcagaatcactgggatagctgttgaattatagaatcccaagacctaccccttaaggctctgatttgtgatatctgggatgctggctggaaatctccagtgttttttttttgtttgtttgtttttttttgagatggagtttcggccttgttgcccagactgtagtgcaatggcatgatcttggcccattgcaatccccgtctcctgggttcaagtgattctcctgcttcagcctcccgaatagctgggattataggcatgcaccaccatgcctggctaattttgtatttttagtagagatggggtttttccatgttggtcaggctgatctcaaactccctacctcaggtgatccacccgccttggcatcacaaagtgccaggattacatgcgagagccactgctcccagccggaaatctcaagttttaaaaatagagttgggttgtgctggacagcagatttggaaaacttctggtttaattcaaccccctcattttacacattggaatgtggaagtcagaaaagggaaggggtttgcttccagccattcagcagaaaggagtccgggtaaatcaaggaacctttctgtaaaatcagaattatcacataattttctggtaatttatattttgaagtgtgaaaaacttcttaaagcaacgttatgagcaagatgtagggtttggattagaaatgctgtaggagagatttttatttttttttccagaaagcctgagatattagctattgttgcagcaaaacccatttcaagaccacctgcttaaaaaagcagacttttggagctttgatttgattttctattggagtatcataatttaaacttatgttcagagaccacctgcttaatttggctgcaggaagctagcaaagtacattgtatcatggaaaaatctagttaaggaaggaagtgtttccaaatacagtttactactttgataggaaatacagtccttaataagacaggttttttgcccaaggatctccaggctcttccataatttctccaaagcccagcgctctgcatatatcttcctagttcttccttcagaaaacctaaatgatgcaaaatgataccacagtgttgaatgtttgattttaaggtgggtggatttaataaggaaaagatgttttgcgtctttttcattgatcgcttaggcattcttgcttttttgattgatttttaacctgggtggaggggtttgaggagctgtttgagaatgtgatgaaggtcttggaccatatctctagaaaaatgtacatacacaatacacaaacacaggcacacagacccccccaacacagacacacacacacacacacacacacacagacagacacagacacacacacacagacacacacacacacacagttctacacatgatttcaggtggggaggtctcccaccctgtcctcatagatgcattgggcttccatggacttcatctctccattgccttgctgtgataagttgcaccttcataatggaaactcactctgattcagaaccagctgaacactggttgctgagaacaatgcgtagaagggttgactgcacaggccacttcgtttgatggtttgcatgtggcattctggaaggagcatggctctgccattggagagttctgatacagaacccaggatctggttttggaataaataacttctccaagcttaggtttcctcctttgtgcaatgggtctgacggtctgccctggcaggtgtgaggtgatgatgtggcaggacgtgcacagcaggctggcacagggccgtcctctcgtgtgttccctgagggaacccaattctgcgtggcctgtaggacctactggctgggcctcctaagctggttctttgtagctgccctggcaccagcactgacgtgcccataccagaactgatcatgcctacactagaagtgaccatgccctacccacagtagtactgactctatccacgcattactgacccctgcccataccagtattgaccccacccacaccagcacaaaccatgcccacaccgtcactgaccctgcctgtaccagcacgttcctaggggccggttcagggataggataaggagtagtatttgggagggaggagcttgctttgttagtgagacatattacaaaaataactaatgagaccttaaaatgctttttacattttctccagatgtctttctgttggtcttgaggcaccctgcttacattgcagccactgcggctgttttcatgcagtgcaaaaagcctctatttgtttaaagtctgtttaccctgatgctgttgacaggcccagttggtcctcctgcttcactgtcagtggaatttgctcaatagatattaaaaggaaaaaatcagttttctgtatttgtcttcccagtggtacagtgcttgagcaaaactccaaagactaaatatgtttgagatgctggcagactcgtatctggctttaaggtgtgtgacctcaagactcgaagtctcagggtagttttttagatggaacatttattggcaattcaactttcctctttaatttgtaactataaagatgttctctaattgaaatttatcattctttcaaatgactctgtttcctttttcatattgttaaaaaagcctgtttccatcggcttgttaattacaggaatataatcctaacgggtaagaggcacctatggttaattttctgcccttagacctgcgtgttttgttaacaagaaagccagaacctactgccagatcacaactcttgatctcttttgttacacagttgtctgtgttctttaaataaaaactgtggtaaaaatcatcttacaattttgttggatttgaggaatcagagagaatattccccaaaatatgtactgtttatttatttatttatttatttatttttagtatttattgatcattcttgggtgtttctccgagagggggatttggcagggtcataggacaatagtggagggaaggtcagcagataaacatgtgaacaaaggtctctggttttcctaggcagaggaccctgcggccttccgcagtgtttgtgtccctgggtacttgagattagggagtggtggtgactcttaaggagcatgctgccttcaagcatctgtttaacaaagcacatcttgcaccgcccttaatccgtttaaccctgagtggacacagcacatgtttcagagagcacggggttgggggtaacgtcatagattaacagcatcccaaggcagaagaatttttcttaatacagaacaaaatggagtctcccatgtctacttctttctacacagacacagtaacaatctgatctctctttcttttccccacatttcccccttttctattcgacaaaaccgccatcgtcatcatggcccgttctcaatgagctgttgcgtacacctcccagacggggtggccaccaggcagaggggctcctcacttcccagacggggcggccgggcagaggcgccccccacctcccgaacggggtggctgccgggtggaggggctcctcacttctcagatggggcggcccgtcagagacgctcctcacctcccagacggggtggcggcggggcagagacactcctcagttcccagacggggtcgtggctgggcagaggcgctcttcacatctcagacggggcggcagggcagaggcgctccccagatcccagacgatgggcggccgggcagagacgctcctcacttctagacgggatgacggccgggaagaggcgctcctcacttcccagactgggtggccgggcagacacgctcctcacttcccagacggggtggcggccgggcagaggctgcaatctcggcactttgggaggccaaggcaggtggctgggaggtggaggttgtagcgagccgagatcatgccactgcactccagcctgggcaacactgagcactgggtgagcaagactctgtctgcaatcccagcacctcgggaggctgaggctggcagatcactcacggtcaggagctggagaccagccgggccaacccggtgaaaccccgtctccatcaaaaaatacgaaaaccagtcaggtgtggcggcgcgcgcctgcaatcccaggcactccgcaggctgaggcaggagaatcaggcagggaggctgcagtgagccgagatggcggcagtacagtccagccttggctcggcatcagaggcagaccgtggagagagagggagagggagaccgtggagagggagagggagaccgtggagagggagagggagagggagaatgtactgttatagactggacagatttattagccagatgttgcttgtgtttttagttggtgactacatttagccatctggccaggaagttgcttaaccttattgtagataacgtccatatgtttggtgttcacatacaatagaacatctgtattgaaaatcttcctgtggcctcatgtaaggactcgaagtagaaggggagacatgcagggatccctattggggtcagtggggagtaaaaaggtggtggatagatctctcctccaagttttcttccctctctccttcctcaactctctgatgatgtcacaactgccagctatgtgtttgggttgatggatgtatatgtgattgcatatatatgtgaatgtgtgtgtgtgtgtacatatgtagtatgccttaggtggggtgcagtggctcacgcctgtaatcccagcactttgggaggctgaggtgggcagatcacctgaggtcaggagttgagaccagcctggctaacatggcaaaacctcatctctactaaaaatacaaaaattagccgggtgtggtggcacacacctgtaaccccagctactcgggaggctgaggcaggagaattgcttgaacccgggagatggaggttgcagtgagccgagatcgcaccactgcactccagtatgggcaacaagaacgagactgtctcaaaaaaaaaaaaaaaaaaaaaaaaagtatgccttaaaacttttcatattttacataataattagtaatacatacttcacttgggccttgtagatctgtaaaacttctccttgcaagacaaagccactgttgattgcaatggaaataaaaattgaggatttttttttttttttttttttttacttctcccaagatgacacattttaagctaaagaaagcagcctccaagaattttatattcctaatattttgggcaagcccgagtttctaggttgtttttacctgcccagttgctgtggtggaagttgtgctagaaaattcagcctccttggtctatgtctgtgaacttactaaattcttgttgttctagaattctagatttggacctggtggttagagatgaagatgggaatattttggatccagaattaactagcacgattagtctcttcagagctcatgaaatagcttctaaacaagtggaggaaaggttacaagaggaaaaagtaagtttgactctgtcatatgccattcacgttttctcagtaataagttttcaacattagtaaagtatcagtcaagcccaaaattgtcactaagaaagaacctgaaaaggagtagctgcagagtttgtgtcctacagtcatgagtggaatggagcctggtggcacaggatgtcacccatgacatgaaagggggtcggacagcattgtgtttcatcgtaggagacaggatcctaatgatgttgattttgtgttctcatctgtcaaatgagacacaagacttgattctgcatttcctctcggataatggtaggcaggtcatgtattccaagctcattgagggcagagagtacatgtcttattgtcttttcgtcttctatgatctttaatggtatcatgtatgcattagcctgttctcgccttactataaagaagtgcctgagactgggtaatttataaagaaaagaggtttaattggttcatggttctgcagactgtataggaaggatagtggcttctgcttctggggaggcctcaggaatcttataattatggtggaaggcgaagtgggagccaacacttcacatggctagagcaggaggaagagagagggtgtgcgggggggtgctacacgctacacttttaaacgacgagatcttgtgagagctcaccatcatgaggacagcactgagaggatggtgctaaaccattcatgaaaaatccaccccatgatccagtcacctcccaccagtatatatatatacacacacacacagtagatactcagaaattgactaattgaatcatctgttaattcaacaagtacttactgagcatctactgtgtaccaaatgttgaagacataatgatacatgagacagatgtccttggagggtttagtctaatgagggaacaaaaaattaaataactacacatatataatcattattttgatttattggatggacacctgaaagttttgtatctctgaaaatactcagcacagcagttgcacaggatacaattttttgtctgttgtgtgaatgcatgatttaagaatgtgcaggggagataagaaagtgactgcaccaaggcctttgctgggttatgccaatgagttattacaattttctattctgtagggaataaagaaagcaagtgtcagtgatgagtgttgctggggttgactttctgtttccttccatacacagtctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcaggtgggtgacatttcttggctgccgtctttcctctttggttagtgttaggaacttgggatcagaaccactgaagcgtcccattcatgctgagaggccttggatgaatggctgctggacacgagcaagcagccgagtcaagagctgtcttagacagtgtgatggcagccaggttgggctctgggtcagggtgaaccttcttgcgtgtagattgctatttgctcgtagagttatagcagttgcaggtacactctggccgtatcttaagagtgtagctgaagattgaagtaatactttgtttcctaagttgtcttcgtaagattttatatatcctggtccctcaaatatcactatttccatttttcaaaatttggtttctatgaatgccatttctgtgagttttgtcttgttttttctgcaagatgattggctggaatacatcatttagaatggtgcctgccacatacagactgtcagttaatatttgttaaatgaaaacactgtaagtctattttttcctgcttagccttcagtataactttctctttgcccagatggaaacaatgtggttcaactatgtatgaattatgtgtgtgtctgtgtatatgttaaaactctagtatcttcacttgtattattcaaaatttgaaaacttagtgtatgaatgatacagaaaaatacgagtggattttattctcacttctgataaagactttgtttcctcttgacataggatgcagtttttattttacaatgtatttggtttgtcataggttttgaaataaacatgcattgtgctgaattttatagtattgtcattctaaatgaacaaataggctcttaaaaaaaaaaccaacttagaaataccatttgcaagtagttctattacagtgacaacccaagacattgcacattaaaacttggcaaggtttttgtgctgtggatgttaattgatgagtagctgtatgtgatacttttgatatttataaactcaatagttgtctgtatagtgcacgtacatggtattaattatgaagcaatgtggatgtacatttggtaccctgttatttggaaaattaacttgcttttatttctccatttttcaagtgagaactacctggttcgctggtccagttcaggattacctaaagacatagacagattacataatttgcgagccgtgtttactgtaagtgcacccaaagatgcttagttgaattggctaccattctaaggactacttttagccatttctgtctgccttcctgcgacactagaacatgggtccctgggatgcctgtatacaggttaatttagtattactaagtagagcgcatttccagaaatcatctgagtctctagccacccttagaatcaccgtgacaaagatttaccccattaacatggaatgtgcctcttaaatgtgtatcgtttttatttttttccttgagacggagtcttgctctgtcacccaggctggaatgcaatggcgtgatctcggctcactgcaacctacgcctcctgggttcaagcagttctcctgcctcagctcccgagtagctgggattacaggcatgcaccaccacaccttgctaattttttgtatttttagtagagatggggtttccccatgttggccaggctgctctcaaactcctgacctcgtgatccaccctcctcggccttccaaagtgctgggattacaggtgtgaggcactgcccctagcccttaaatgtgtatcttaagctcacttaacagtaattgactattgttattaaattcctttttgtcatatgaataactgattaaaatgataaaaactggtctgagaagagtctcaatccatttttttactgtccttttcattggagcttgcattgaataatgggtctccaaaataatttatggaaactaatatttctaggacctcggaagcaaagacctgaaaagggagaaaatcagttttgtctgtcagattgttcgcgtgggtcgcatggagctgagggacaacaacaccaggaaactgacctcggggttgcggcgaccttttggagtggctggtaatctatttctctgtgtttccttgagagtttcagatcttcacagtcactttcaaaagaatcactgttgaatgttgattggacaatgcacagctgtgatttataagcttttctgctggagagaaaaaatatatttattagttattttcattgtggcttcaagttgacctgctaggctcaggatgctctagtcctcaagtttcagatataaatcatatatttggttttaaagtggatcccatctttccctgggagtgatcctgacccatattctcagtctgtagggaagccagtcagtggaggttttcaggtcttggtgatggacataagaatggatatgtgcaggacggtcaaagcaacgaagaagaggaagaaaggcaaactgtgaagagaacgcggttagcttcatgttggtgctcttcatccgccatgttggtgctgtttctccgccatgttggtgttcttcctccgccatgttggtgttcttcctccgccatgttggtgcttttcctctgccatgttggtgctctttctccgccatgttggtgctcttcctccgccatgttggtgctctttatctgccatgttggtgctcttcctccaccgtgctggtgctcttcctccaccctgctgttgctctgttatttttggtgacagcacgaggaatgtgaaagaccaattatctctgttgaggaaagataaaggcatacccaggaagttctgattatttgccctagttcactgtgactctcatttttcatagttttgggaagtggttttctctcttttatggttgcagtacaatttcattacctagcactgtgatatttattttaatttttgtgatttttgggattcatatggatatttatgagggaaaagttcctgattcttgacacatagctggatttttttgtatgaacagctatggaagacattctttcccttggctaccaggaaactctgaacttagtccatcccccctgccttttaaataaacattatttttagaagagttttaggttcaagcaaaattgaacagaaaatacagacagttcctatatatttctccttccttccccctgcctccccattatcagtatccaccatagattggtacattgattacagttggtgaaccgcattgacacatcgtcgccctgtgaagtctgtagtttacattagcgttcattcttgatgttgtgccttctgtgggtttcgacaaatgaataataccgtatattcaccattgtagtctctcactgggtagcttcaccatcctaaaagtcctctgtgctccgcctggaatttttggaaaaatatttcaaatcatttaaataaatgacttactacatcataaggagtaagcaatagcagcgatatagacattatgagagcagcatattaattcaatttacttgaattcaatttacccatagagctaactaacggagtgttccaatgattttaccatttgtgagtgaaaatggtgagggtgaggtgttctttctgaagtccccacagccttgggctggggaaatccttttgcattttcatctttctgtctttttgtttttatgagacagagtctaactctgtcacccaggctgtgtgatgacagctcactgctgccccgacctcctgggctcaagtgatcctcctgcctcagcctcctgagtaactgggaccacaggcacatgccgtgctaacattttcatgtcatgacttgaatacatacttgaaaattgcccctctatttgtcagagcctgtagcatcttttacatgtaatctagtgttatatttaaaatgcctttcattttccaggattgttttttttcttttccaccttgatggtagttttaagaaaatatttaatttttgtctcaggcataattggcttcatttgagcaatcagagacatctttgacaacacacggaagtcgctcctcttttcaacagcagagctacacattctctggttattagattacaagatggattgtgtcataagttcctacgaatgcgtagttatatttcttaaagatgaaatgtagaccacaggctgacagtttttaccttcttttgattaaaatttttggaatttaaaaatttggaatatttttcagttttcattgggttgatattccaggaaagtctaggtactaatggatggagagggtgatgggcatgggctcagctgacaccactgtggccttccactgtttcttacatgctcacttatgcttgcttggtggggtctagagttaggttgggccccccagctcctggagttctccatgaattacagaagcctgggttattcactggggcagggcgggcagcctggacatagttccttgtttctggagcccctacctgtgtagtgttggctgagacactacatctggtccctggagtttggatgcctggctgtgtggcctccagggacttctgtcccctgatatctgctgatcacatggacaccccctttggtccctggttcctcctgtctggactggtctctggttccttcccttcctgtcttgtgtctctggtacccactgatatcggggcttctgaaaacccacctggggccaagttctagccttgtcgtcttgctcgtgaattttccagagtgtggcttctcctcactgctctgctctgactggcacatggggtgtcccccctcacttaggggttgcaaagaacctgtgtgaacctgcatgaacctgtgtgaacctctataaacctgtgtgaacctgcgtgaacctttatgaacctgtgtgaacctgtgtgaacccacgtgaacctttatgaacctctgaacctgcatgaacctgtgtgaaactgcgtgaacctgtgtgaacctctaagaacatgtgtgaacctgcatgaacctgcgtgaacctgtgtgaacctttatgaacctgtgtgaacccacgtgaacctttttgaacctgtatgaacctgcgtgaacctgtgtgaacctgcgtgaacctgtgtaacctttatgaacctgtgtgaacctgtgtgaacctgcatgaacctgcgtgaacctgtgtgaacctgtgtgaagtgcttcagagatacccataggcatttgttttcctctgtgggaagatttcaggcctgcagctgttaatgttgggttgccgggtcctttgagttctctgtcccttctggtgtcacagttgcctagcagttgctggtttgcctggctccactacatgccctgggtggggatgtcctgttcatcccttggtgccaagcactgagcactgagcctttgtggcctctgtgctcactccagaggggccagccttcctagccctgctcagctggtgtgtgtctgtacattataagtaagaaactggctgggcgctgcctgtaatcccagcactgtgggaagttgaggtgggcagatcacatgagtttgggtgttcgagaccagcctggccaacatggtaaaacctcctatctacgaaaaataaaaaaattagccaggcatggtggtgcatgcctgtagtcccagctatttaggaggctgagggagaagagttgcttgaacctgggaggcggaggttgcagtgagctaagattgtgtcactgcgctccagcttggggaacagggagagactctgtctcccctcccccccaaaaaaaaggccaggtacagtggctcacacctctaatcccagaactttaggaggccgaggcaggcagataatgaggtcaggagttcgagaccagcgtggccagtgtggtgaaaccctgtctctactaaagatacaaaaaattagttgggcgtggtgctgtgtgcctgtaatcccagctactcaggagtctgaggcaggagaattgcttgaactggggaggtggaggttgcagtgagccaagatcacgccagagtgatggggcgagactccatctcaaaaaaaaaaagaaaagaaaacaaaacaaaacaaaacaaaagtaaggacctgatcgttctgcttgtggagtttccagtttcctactagaaactcttctctgagacatttcattatgtgatctggctatgtaaatttttggcacaaaaagtaaatatcttaatgcagtggttctcaatcctaactgaatatgagaaaaatcttgcgagctatcaataaaaattcttggtcaggtgctgtggttcatgcctgtaatcctagcactttgggaggctgaggaaggcagatcgcttgagcccaggcattcaagaccagcctgacaacatggcaaaacctcgtctctactaaaaaatacaaaagttagctgggcgcttggtggcttgcacctgtggtcccagctactcaagaggctgaggtggggggatcacctgagcctagggaggttgagactgcaaatgagccatgatcgtgccattgtactccagcctgggctacagagtcatcctgtcccccccaacggccccctgccccgccacccccccgccccaaaaaaaagaaaaaagtcttgcacaagccccactcctgtccaggtaaaccagaatctctactttaaccaaaatcgcttgtttgtcactatgggccactcagtgactggcagtttgctgccaccagactaccttgccctccctgctctgccccgcttatcacatggtggcattcagcacatctggggaattttttttaataggacttgcttctaacttattcagtgtgttgtccaaccagatgttctctttgttactaagaaaggatacttggtcgggtgcagtggctcacacctgtaatcccagcactttgggaggccaaagtgggtggattgcttgagtccagcagttcgagaccagcctgggcaatatggtgaaaccccatccctacccaaaaaaactaaaaaacaaaaattagccggtcgtggtggcgcatgcttggggtggccaaggcaggagggattgcctgagcttgggaggttgaggttgctgtgaaccgtgattgtaccactgcacttcagcctaggcaacagagtgagacactcaaaaagaaaaaaaaaagggatagaagggatgcttcccacatctgagaaggttgatcaacattttggtaatcgtattctatctgttcataggctacttcaatttccacatgcaaatttaattttgaggctttctttagaatgacttctgcgtgtctgtgttaacagagttcagttccttaaaatgagaaagtgtccatggacctttaagtctacagttcttagtcttcggttgaaaagaatgtgtcacatttctgtcttttaacctttttataatgtaaccttttctatctttttctaaaagatagaaaattgtaaaaataatggaaattttatggaaaagtgtagttaaataaattatccatagttttacatagccagggtagtacctcatgtttattctgatatgtttgtttccaaattattttttctgtgtgtggcatatgatttttaaatacaatatcccgtcctaccatgtatttgtttatttaactgattgattttttaatgtctttttagtcccttttttgccatcttaaccatttttaggcgtgcagttcagtagtaagtatgtttgcattgcacatacttttatctttctaacaaacctagcattatcttatgaacatgtccttttattaagcattattcaaaaattcggcttctcaatggctgcagcctgtagtcctgtgattccagcagtcctttgctttgggctctgaggttatctcagccttgcggtgtagtagctacgcagtgagcatcctggggcttgaagcatcccacctgtgcctgtttgcaggccagcccctgcagcggagttgctgactcgcagggtgtgggggtccatctgccgtgagcaagtcatcctgatgcagccccaccagtgggactgagccatcagcccctctccctgcgagacgtttctcacctcctgccttctgctctcctgcctgtgctggccctgggcctctgtcactcttgtcccaacgccactgcctccttccttctcctgccctctgtcttccagcatcacgcggtgccgtctgtctacccggcctctccctcacacagctgtactgacttcagctggactctgtcttttcaccatcctcttccctgaatgtagagaccctgggctggctggctgggggaatttttcccccaagtcctttatttcctcctttggtgtcagggacatcttgtccaaactgcagggagcactccctctgcgtggggctgtgtgcggaagagcagtcaggggagtccctgggaagcgcgatgagcggtgatgactggtgacgtcaaggccttctcctcgaggctcaggatgggtgcgggactcggggtgttttccacctgtgggtgctcaggctctgattgcgtttcccgcttgtttgctgccttcctgcacatggtcctgtgttccagggctgggcactggggatgtggcaagggagtcccatggtcagctggtgagatgagtcccatggcagagcagagctctgcaggcacccagcaaggccacccaggaccagctggcatgtgagggtgggcctgctcgggtcagactcccttggttctggctcatcgtgggctgctgcctaaatgagtttattgaaggatgctgaactggtggtctcgggcatcttggaaaaaggtaaaaaggtgggtgctgcagtcagtcgcgtgtgggtcagtcacccccaagagtgctggaagctgggaaacgcttcccccaggccaggtgagggcccgtgtccagaccatgcatcctctgagcagctgtcatttgatgttgcaagttatttgggattctttgacctgtatctgcaaacacagccgtgggctcctggctctttgaggccccttggttgagtggagtgagtgtgggtgtcgtctcttacgacactgctgaggcccctggggccccaccagaccaaacaggggatgaggatgctgcttttttggttctatgtatccctcctcctttttggagggtggtgatggtgatggtagaaaggaaaattttcaatatatgattacttacatgttggacaaaatatatttagactgatcctcttacctgaacgcagagctgggctacagagagacccttctggggaaaggtcttgtgcgaagaaaataaacaaggcatcttcctctcaagtccagtgtggcggtggagcagtagcagacacagggaaagtgacccgggccatctggggttattcttggactttcttgttctgtcatgaccaagggcaaaaggaattgtttgaaaggtagacagtgtgtctgggtttacccctgaatgtcatcagggaatgtcttttaacacaagaagatggcaaaggatattagcctttcttgtgatgttagcaagcctggatctcccggggggtgtgtttgtgaaggcagtttaataggattgaaagagcttgggtcttggagactttctcgctgtagactttgagcatgcttgttcatgcctgtctttgagcctcagtttcttgtcagtatggtaggttactgaggatttgccttgaagtgtcctcttgaaagagcgtccacagataccagcatgtggtgggtgcttggtaaatggtagctacttgttggcttaattgtttgcgggaaagcaaaagtgtgaggcttcagaacagtgctggccagcgtggtaaccacttgtcacatgtgactagttaaatttaaattaaatgaatgaaataaaagtaaattttcagttcctccatcacgctttctacattttctttttttcttttgttttgtggcagggtctcactctgtcactcaggctggagggcagtggtgtgaattctgttcactgcaacctccacctcctgggcccaagcaagtctcccatctcagcttcctgagtagctgggactacaggtgcacaccaccacgcctggataatttttgtatttcttgtagagatggggttttgtcatgttacccaggctagtctcgaactcctgggctcaagcactgtgcctgccttggtctcccaaagtgctgggattacaggtgtgagccactgcgcctggcctatgctttcacattttcgttgcttgttgttaatggaacattttccatcattacagaaagttctattggacagggcagctctagggtgacagttgggtaataggcaaaggaaattattaaatggaactctgccatttgagccccaattccatttgggccagcattttctgataacttaatttgtctttcaagcatggaaataatttagacttgactatgagaaaacagcttttgctgttgtttgccagaagatattctgatgttcctttgtttgtttgtgttctgtgattatagcatttaagccaaaacaatctctgttctctttttgtctccagtgatggatgtaacagatataataaatggaaaagtagatgatgaagataagcagcatttcattccctttcagccgtaagtatggagcaattcaagtacttagccagatataatgtggaaaacataggcttgtaataattatctttataattaaatggataaacataactaaggattgattattttgtaattatgaaaaacctctttagtcactgctgtagtacatggaattttttgtagccataagaatcctgggtcaaagtttgtttatggtcctggaagtaggagattttacttgtaatcactgaattgccttatatagaaggcacagagttacagctctgctctgagcctgaatgtttctttacataattgatttattctagtagctatttgtattttcaaagcacaatacttccaaattcatcataggaggttgctgtttttaaaataaaaaaacaaacaattatgatgaattattttaaagcgagaaataatgctttaaagcatataatcacactgctgatttttgtgtctcggtttttgcttagagtggagcctatctgtgttcgtttttaggctttctctagttctgacctgaagtctttaaagaggcacggaagctgagaaaaagctcttggaggagattcattaaattgattatctgatttgtgggtagaacccagggaactggtgggaagaactggcgtttatttccctcgtgtggaagcaagagtgtacccagatgatggtcgttggccacttaagcactcctactcctcacagaggaggagagaaaaaggaatccagatggttgaggttaattgtaagagacagcttcctcctgggcgtggggttgggtggcgatgttaggggagaaggcatggtaagggcagtggaagccacctgccatagtgctctgcagtttcacttttccctcatttttattcttaatcgacttcagacttgaaacacatttcagattttagaaattttacggttttcagctgttggctgaagggtttaggaggcgggtagtaattgggtggctgaaggagccctgtccttgggggcccggagatgtgaggttgacttccctctgccccacgcatccttggtgatggaccaccgcgctcaaccccacccgactcctctgggtcttgagtgccactggctaagacaggaagagtatggctttctttgcaggcgggcgatgtggtcacatagcaccctaaagctttttgtacagctcagtaggagattttgctatcttcttgacgtaagaataacagcaaaccctgcgttattgagctgggagtcagggttaagttatatgtatctcagcatgcacaactagaggcaaaggtctctttgtggcttaaatgctttaggtttactctcctgtccaatatggtaaccattagctccatgtggctatttaaaatacttaaaatgagctgggcgcagtggctcatgcctgtaatcccagcactttgggaggccgaggcaggaggatcacctgaggtcaggagttcgagaccagcctggccaacatggtgaaaccccataactactaaaaatacaaaaattagccgggtgtggcggcaggtgcctgtaatcccagctacttgggaggctgaggcaggagaatcgcttgaacccgggaggcagaggttgcaatgagccaagatcacgccactgcactccagcctgggcgacagagggagattctgtctcaatgataatagtaattagaatgaagtagcattaaacatttagttcttcagtcacattggtcctgtttcaagtgttcagcagcaggggaggtcagtggccccgtcctgggcagcacatacatagcacatctccagcactgcagaaagctctgctggattatgttgttttgtagtcccatccagtgaggagagtttataaagggaacacagtgctgcagaatctggaagtttccttagcaaacaaggggaacagtatcatggaacatgggcagatattgaggtcataaataaaatacacctttgtaaaattataatattaaattgcctcattctctcatgagaaataatgcagccccctgctgttttgaatgctgtattatatattagacctcagaggttcttgatgcccagatgtaacactaagttgaaattacctgttgcctgctagtgtcctctgtgaaaagtcaaaaacaaaaacaaaaacaaaaacaaacccaacctgagggattgtttgaaaggttagggaggttattagttttagattcactgattttcacagaacatgttatgagttgtttgagattgcctgtgctttgacgccatctttttctatcttgtagtggaatgtccacttgaaaaatatgttattccatgtgtaactcttatgtaatttgtgactccatgctccattaaaggaagactaatagacagatgaatatttgaagtgttggaaacaaaagaacagcatgatttttaatagcaaaataagcagtgaaaccagttctttgggaaatgtcgtgctaatgaaaccattttttgctccattaaaactgatttattatctcacagggttggttttagagaaggaagcacattgcacatctccctccctccctgtcttttttaacttggtgacgtaaatgacaacagtcttcagttccctcgagtcatgtggctcaagtgatggatagcactgtccttgttcccaggattgattttaaacattatggccatgctgtctattttcttgctcatttcatagtgcacttcgctgtgctacatggtatttctatttgggcatatgccccccgtttgtagccagtctctcgtacagcgcagcatctgtcacaggctcctggttcatgggccctgaaaacgtgggtggtctgtgttcataacagcgccacacgtgggactaggcagtggtgttctccacacacggtaccattcttctcacatgtagtcacttgagggactattgtgtacgtagtccaggagggtagagtagaaagcctttgcaagcagttaggttccagggatttttttttttttaaatcttgattttgcttttccctttagatcaacctgccccttgacctatgctatgttcagaattaattgaaattggaggaatggccataaacattctttgggattaaatgcctttcaaccatgtggctttcagacaagctcctttttttaaacacaagagtctgatggagatgcagtggaggcctggtgcacgtttattcctggggagagggttgccctcatttgctctgttccctctcgtggttcagcattttcctgatcaatgcttttccctgtttctcttgtcacctctcccatcctttgtcgtgcgttgactcatgatgcctccctctcgcactcggtgacgatgatctcttatgttcccttgttaccgtggcccatgggtctctgtgcccctttgtctcctgtggtcttggtcgtcccgtgccctccaggctcgcgttggacgacgccattcgacacaagccgctgaacatgtcatcccgtttttcacccagggtggcaggggagaatgacttccttcagactgttataaacaaagtcatcgctgccaaagaagtcaaccacaaggggcagggtacgtattttcctattttgtttctatcagcgtgtatttgcatgcgttggggcagtgctgtctgggttggttttagtttgatgttgatcatgatggtggtgataatgatggggatgacagtgatcgtggtggagaatgtgtgtgacagttgcccctgtgtacagtgcatgatggttttcttgcccgtcacctttgtgaacattgctgagagcccactcctggatggagagtggggtcagattagaagtttagaggaacatgcaggcggtaggcgtaactccctctgcccgtgttgtgtgctaatctttgcctgttctgggtcttccctgctggtctccctaagaaggtgatttcatttgtgcagacttgctcccctgagttctgtcatttaagtgatttctccgcccctacactccgcctcacactcactgtttttaatcctgcactgacacgtttctgagcagctgacctgctgctggcagaaggaatgaatcagtcacctcgggctggtgacagttggcacttggctggccaggagggctgccaggaaacaactgtgactgaggccccgcctccagcccaaggggaagtcaccttcagaacttgaccgtctcactccctgatccatgcagactgcccgtaaacgcggtagagcttaggtgaacagacctgcttcatcgtccagctaccttatgtcactagacttttaaaaaacaattatcttgattcatttccactgttctaaaggagaatgtgaattgagcctgaagaatgttttagagaatgagccttcctagggatctgcagggacctccagctttcttctggtgtgaactacccccctttctggcaaacagtagcaggacaaaaaccccaacccagaacgttaatgagatgtggcctctgcagacagagcgattttcagctgacccaggacccatcttctcctaaattaacagccctcccaatttacactttaattgaaaaccacggggaggtccaattagggctgtttagattggagtcactctcaggctgggagtgccagtgcaaaggttgccagccgatccttcagtgcttcgagctgggactgccctcggatctccagtttcttttgcagtcatcggagttttgataaacttttattagagtcattcagggaaagtggagtttggtgtcaggccagcaggaaatcactgggaaagaggaccagaagcctgcctctgccaggctcactggtgtgtggccaggatctttgaagccggcgaaccttgggctcatgtccgggggtccagttccttgaacttctgggaggagtgggcattttcaagtcacagtgaaaactgagggagaagaacagtgatagttttgtcaaggggatcacaggtgacttcctgaatcagaatggccttaggcaacatgactagtgcttgttttccttgaacctgaattttctccagggcacaatggtgggtggaattcaggtcagaggtgagtgatgtggccagtgagggcagccacacagatcggccgccgggactgcagggcgctgcccaccggcgctcattttatcaccagcagcccaggcttaacctgatccttgcttgtctgtcaagtgactgttagcggccccaggagtggaagggacatggaggagatactcatcttcagagagaaccactgggttttttcacacctctgtccacatgcgcctcctgtctcttgagctcaccacttggccttggccagtttttggtttatgccaacatgtttcctcttcacaagagacaaaaatcctgaatatttaatccaaattattctgatccctgaacccagaggtgtgggacattttatgtggacagtgaattcatgaagactccagacatctggttctgttgtttgagatagaatgtatgctaatcctctttgtttttagttattctgcttaagcaaatgtcaaccccaaatgcacttttttctcctgtgagaaaagcatttaaaacacagcataatcaggaacatttaatttccatttttaaagcgtgtggtaataaatttaatgtgtcactagtgcattagtttatgtattaagatatttgcgcaggccggcgtttctgagaaaggtgtttgaaacacaggatttctaatattaagtgttaagtgttccatcctcatgtctcaacctttgacctctgtagataatgacctcaccacatcctgcaatccttcaaagagcatctttctgtaagatatattttgtggacattcattctccagggaggcttttggactcaaactcctgagatttgagaaactcttagctgcatcctggtgtcccagggaagaccagctccctgtgagccacggtgccagttcctcaggctcttctgtcagggtctgggctttggtttgctctcccggaggccagggctgggggttagggtgaggaagtgcctggccctttgcccatctgtctgcttacctattctgcaggtctggagctgctgttagctcagggtgcttttgtgtgaattagaaaaaggggcctcatcaaccaggtgagtagggagatgcagccagcgccaggacctgtggctctgtgagcgagtagaggcagggtttagctcccacttgccttttgtggtcacttgtctagtgaaatgcacattctgggcagtggtacatgtgctcctgtctgggtgccatccccgatacctctttggggaccgctttctattggtggttcttccttcttcaaactctccctcccatgatctggaatttcatatcttaaaaagaaaggaaaaagaaaaaaaatatttaaaaaaaaaaaggaaagaaaagaaacaccaagaagcagtcctaccctgagtaatacatctgtctctgtctatgtggcctctccctctggtcttcgtctcccattcatcttcacccttctgcctcccagcatcggccctctccctgagcgcccccgccccctctgcccccgtctcccaccaggagccctgtggctgcatgggcaccatctgtcccagttttccatttcccctgttatctctgaggtctctgtccccttgtgagctctcaaagtgggcctttctcctgcctcttcggggctcttctttccttccccactctgggtgcttgcccttcaggcagctctgcctggagcgagcgggtcttcctatttcaaggaacggtgcccccgggacttgctagtggttgtgcctgcaaggggcaccgtctctgtaagctgcgcctcctcctaccccaactccccgtggttctgctgacttgaccttcacgctggtccctctcccaccctccatagtggcattcacgtcctgccagccagctaggatcatgcggtggcctccctgctgcgattccatccccactgtgctctgttctcctgcctacccattccctgtagccacagggtgtcaggtcagagcctgactcttgttcctgagccccactctgggtgccccccatccttcagatagaccacagtccctgccaccccagcctccgcactgtcttaccacagcgtctgggggctccacctcccctgggtgaggacaggcctgcagttccctcacttcctgcaggtctcagccccgaagtcccttcctctgtgacccttgagactgtggtcccaggatgccttgcagtgtgctcaggacttctcccgtgagaacttcgcagttgcatatttctctaagagaccatggagttagtgtttgaccgttggcaatggaagctaaacacctgtcaggggaggtcgtgagggtctgccctatgtctccagtaggtgcagtgcccagtatttgcctggcacatagtaggtgctcagtagctacttttgaataaattagagggactcactagatagcaagaggaaagggggtttcaccagctggcaaagaacaaaacatcatcagtgacttttgacttctcagctccagctaatggaaatctgagcaaaggagaatgccatttccaggatagcggatataggaatgggcagccagaggacagggcgtgaggtgcgggattgaatcaagcagggctgctcccgtcagggacagccggaggtgccggcaccgctgtcggttacctcccagtgctgctcagaaggcaggctgctggagaacaggcctgtgactgtctcagttccttccacgcagggcagggcgctgagctgagggtgatggagggcaggttctgctctggaggcatctgaagaggggacagctgcacacacacacacatacacacacacacatgcacacatacacacacacagatacaaataccacaaacacagacatacgcacatacacacacacacaccacacacacacacactaacacagatataaacaccacaaacacagacacacgcgcacacacacagatacagacaccacaaacacacacacagatacactacacatacacacacacagataccataaacacacacacagatacaccacaaacacacagatgcagacaccacaaacacagatacaccacacaccacacacacacacacaccacagacacacagagatataccacaaatacatacacacgcacacacacacagatacagacaccacaaataaacacagatatgcagatacagataccacacacacacacacacacacacagatgcagacaccataaacacagatacaccacaaacacatacacaccaacacatgatacaccataaaaacagacatacacacacagatacagacaccacaaacacacacacacacacagatacaccacacatacacacgcacacacagatgcagacaccattaaacacagacacacacagatacagacagccccttccactcagatatacatatagacacacacagacacacacatgggtatagacacagacacgcacacagacatatatatatacactcacacagatacagatatacacataagcacagatacagacacagacatacatacagatacagacacagacatacatacagatacagaaagacacagatacagaaacacagacagacacagatttagccacacgcatacagatacacagacacagatacacagagacacacacagacacacacgtgtacagacacacatggacacacagacacacacacacacatgcacagatacagatacacagacacacagtgactcacacagacatacgcacagccacaggcatgcgcgcatacccatgctagtagcagaaatgaggacagaggctttgatgttctgaggggcagatgaggccctaccaagctgagtggggggaagcaagcaggcagccccccctgaggcctcagggacagagcacccccatgtgctggcttatagtgccagccccttcccatggggggaaaagatgccgtcgtcgtagaagacagctcaggccgagcccctgcctgccccgcctttgacttgttggaatgtgtggcttgtttccttgtactgtcacctcctatttggttgctactcagtatttatacaaaccacagttctttgtcagccttgcagggaggaagatcccgcgcacatcccgcacacacgcccttacacatagaccccaccgggtttactgccctctccccaggatacccctggcatctaggtttagaggctttgaaagtcttcatttctctcttggagaaaagagccgagagcggctggggctttgttttcttttgcggtggcactgtggtacagagggcctgggctccacaggctgcacctgtcctggctgcggagggctgtcctgctggtggccctgcagactggtgctccactgctcgcccaggttgtgtgatgctgcttagctacttgaaactttgatgggttctcgaagctacgaattcacctccagaatcctcccctgcctttgtctttcctgggagactagaaaatgacagacttctcagccacctcctagaaaaaggtggcctgctgatttatcttaaatgtctacccactcaaaagagacattggtccttggcattcctcagcagcacagtgggtgcacagcagctgctgatgtgcgttcagctgtctgtgagtcaccctagggcagggctggcatcccagctcgttggatgcatggagtccccacgacaggcaccttttgccttgcccctctctttctcatatacccaccttttctctcaagatgttgaattgtgaattaaaagtctctcattcattgaaattggtttcgtgaaaacttctaaaaatgcataggataaaatgcgacttaagagcatccattgtttttccaggtttgtgggtaacattgaaattacttcctggagatatccatcagatccgaaaagagtttccgcatttagtggacaggaccacagctgtggctcgaaaaacagggtttccggagataatcatgcctggtaagaactggcttgttcagggcttctcagcatggcatgggggtagccggccacggaggatgacgtgtgggcagcatcatgtatgagctctggcaaggaaagggctcagctcctggtaggtgaccctgtaagccccagcatggttatggatcatggggctgtgaccggagtggtagaatatgctccctggccccctgtacccctggatggatcagctctccccagctgcaaggattgtgtgaggggggcgtgggcacccagcaaatgtctgggtagacatcaggtcaaaagaagaaagaggtcagaaagggagctgcccattgtgaagcccacttagggcaaatggcagggttggatggtcgctgaatggaaatgcctgtgcctgcgcccgctcagctagtgtacgttatactggcattcctccatgaattctaagtcatgaattctaaactgaccgataacaggatttgcgtgttaacattaatctcatatttacataatacttttcattttccaaataacgttcctaataatctgatttgatcatcaagagatctttggaagcatgttaatttgtatcctttatatccgtgtgatactttttggtttgcaagtaatgcttacgtggcttggcagggcgtagtggctcatgcctgtaatcctagcactttgggagttcgaggcggggggatcacttgaactcgggttcgagaccaccctggggaacatggcgaaaccccgtcttgacaaaaaaataaaaaaactagctgggcgtggtggcatatgcctgtcattctagttactttggggggctgaggtggaggaatcacttgaacctgggaggcagaggttgctgtgagcacagatcacgccactgcactctagcctgggcgacagattgagaccctgtctcaaaacaaaactaacttgaaccacgtgaggctcttggaagcccacaaattggtgttgagtgaattcctatccagattaaactgtagcctaaagtcgctcagctaatgagccgtggaaacggggacaaactcccccatattcaacgcggcctccttttataggcctgtgctgtatagccaggagagtggtggctattcagggtgcatgctgtaggagttactgctttgcttactttagtgcaacttcaagacacattctttctactccttttgtctttcagggctgttgtgggtcattgaatagtcggtctggtaaatccatatgaaagacatctaaattggttaggctaaataatagctaggcttacctgtacagaaagaaaagcatgacgtttagtcaattctgaagctattgcttgtgtgtgtccagtctatatgcaggaaattaatttaggtttattaatgggagtggactaatttgtatacttattatttgtatttgcatttgagatacagatttataaattaggatgaagcaattggcaatatgcatttatcttggcatccttaggatgtcctcatgttcaaagggaaactcagaagcttccagttcatgccaatagtgtttcccttatgatggatagacttaaaaactaagtctaggcccggcgtggtggtgagtgccaggtagtagctgctagtagcaggtactagggaggctgaggtgggaggatccctggagcacaggaggtcaaagccgtagtgagccatgatcacaaccactgcactccagcttgagtgacagagagagaacctgtctcaaaaaaaaaaaaaactaagtctaaacttgtagatcatctcatgatagattcatagggaaatgatacagttgaccattgttctggcaggttccatgtgctgagtcctcgggtatatatctcacaggaagtgattctagcttgggtgggtcatctgcgttctctgttggccgagtaatcactggccgcgctgtgggcaccagagagagagagagtatgggcggttatcagtctgtctcgctgtctttagcctgcagaacctgtgtatcacccggttttgtcactgtctgcagggatgcgcgtcttctttggacagcgcagagcctgtcccatcacccagcggcctgctctgctactttctcatagctcgttggactcctggaatccttatgaaggatccaggcaggcgatgccaagttttcctttgagctgggaaggtagcaggagtccactatgtctgcttctagttccttcttccccagaatgttctgtaacctggggaggcatttgatgagggtctatggtgaatgcccatttgtggggtttgcttactgtaaatgaggtcttacttctgtgctggccctggagtaacgcacttgaggtgtacttgggagtgaggctgtgggagtttcgccctgtcacccgggctggagtgcagtagcacgatctcagctcaccgcaacgtctgcctcccagtttcaagcagttctcctgcctgagcctccggagtagctgagattacaggcacgcactaccatgcctggctaatctttttattttaatagagacgggggttcactgtgttgcccaggctggtctcaaactcccgagctcaggcaattcacccacctgagcctcgcaaagcgctgggattacaggcgtgagccactgcacccggccttgaagttcttttttgatgatggtgtttgtgccttgatagaatttttaggctgagagatcatggagtttatgccttccttatcagtgaggctgtttagtggtgctggccttggaggctaagtgacttgtccaaggtcacacagcaaatgagcaacaagtcttggttgggtggccttgcacctgcccctcgtcctgtgctccacggttcttctcgtggtcagtatcagtgggcggcagccgcgcctccttccacacagctactgtggctgtggtggcaacccactgggattatgatgataatgacttttaaatgaaagcttaatttaatagttggatacattaaaagccaaaatagagcagtttaaaagaaaaaaaaaagccaaaacaagaaagcaaggagcaaagagagttattttccttaagggatccttggtcttcagccagaatgggcatttgctgctcttgacggaaccgctctttggctccttgggagagcgggtggtcagggcgtgggaggtggccaggcaggcagcagaggagcagtggctgggaacgaggcttcctctaaatcatgttactaatgaagcttgtgaagttctcccagttgggccattaccaggggcttcctatgttctcagtaggaagaagagtcttgagctcatttcttgcgttttttttaccccctacaattaaaagcccatctcactttaaaacagacaggtctgttttgttcttctctctgtggtccccattcgggatcctgatagctgcctgccagaagggaagagccatgcagaaagtttctccctagacccgtttttcctccctgattctaggctggtgatcctcattctttttttctttatttttattttattttattattttaagttttagggtacatgtgcacaacgtgcaggtttgttacatatgtatgcatgtgccatgttggcgtgctgcacccattagctcgcttttgagacggagttttgctctgttgctgaggctggagtgcagtggcaggatctcggtttgcggcaacttctgcctcccgagtagctgggattacaggcctgcaccaccacgcccagtagctaatttttgtatttttagtagagatgagggttcaccatgttggccaggctggtcttgaactcctgacctcaagtgatctacccacctcggcatcccaaagtgatgggatcacaggggtgagccacctcgcctggccggtcctcattcttaatcaacttttagttcaactcttggagtcatgcttttaagaagaatgcataggaggcaaccttgccagttacctgggagtgccagtggatactgcgatagtccttggctactgaggactcagacagccgtagccagccgtctaacaagggacaatggtgtgggctgccatgggtcatggatgccatcaatagtattggagcccctctggttgtcggctaccctgagaggggtagagtgtcctctgcccagatgataaccaagcagatcattggaaactttgagatttttcctctttctagaaaactttatcatgatgaaaattgctcttgtcatgtatttaaatggtgagactgttttgtagaaaatatttcataatcatctaatatgtatttgtaataatctatgaggataggtagacagtcttgcaaaattcacaattacgctattaataatggattgttttttaaatgtatgatttctcccccctcaggtgatgttcgaaatgatatctatgtaacattagttcaaggagattttgataaaggaagcaaaacaacagcgaagaacgtggaggtcacggtgtctgtgtacgatgaggatgggaaacgattagaggtatttattgtggcgagggctcatctgtagtgtttcagttttacttgccaagtgctcaccttggctctgctacagcatagatgtcgtcagggtggggctttggagtcccgtttcttgggattggcgttggttcttgtttccttttctccagcttgccatgcagggcctggggtcctctggtcctggcagctggcctatctcaggaggtccctgtggtcttttttttttttttttttgagatggagtctagctctgttgcccaggctggagtgctgcaggtgtgtgccaccgtgcctggctaatttttatattttttagtagagatggggtttcaccatgttgacctcaaataatccgcccgccttggcctaccaaggtgctgggattacaggcgtgagccacagtgcccgagcaggtccctgtggtcttgaccacctttgcccaaccttatcgtggagtctcatttgctgtcacaagcccaaggcctaaaggtctagcagtcacactagaagtacagataccattgttacgatttgagagatgaagaaaaatgaaggccctaagaaatcaattaaattgctcagcgttagagagctctaggggtggaactgagcacctgctcatgacagccagagctctgacctcgtgctctacctaccggcgatcatgaagatctgcttccgtggccacagcagcctgcagggtccacctgggaggtacttagaagctattgcctcctctgatgaccagaggtcaaatcagagctgctgtccctgtgaggtgcctctttgcaccagtgctggaggactgggcttttctgggcccatggggttgtgcctaaggctcagtgtcgccaagagaagcattatgtctttctctctgggtgaactctgtccagcatcactgcctgcctcgtctccctggaaacataggtgctgcccttgccactggtctttctggttggagtgaagcaaacagtgttcatggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccgctggcttcaggtggatctgtgcttcccttgctgggaacgtgttcatttgtggtgggggtgtgttggtgttcttggagcgtacctgtccccccacatatatagtgggagatgtatatggtgtcaagctctatgaggtcttacgtgagctctttatgtcttcttttaaagcatgtgattttcccgggtgctggtgatgaagcgatttcagagtacaaatctgtgatttactaccaagtaaagcagccacgctggtttgagactgttaaggtattatttacatggtcattttatcacatggcgctgattatgaaatgctcatttgtaacccaaggaaacatcctaacatcctcctcagcccgggagctgctccaggcaggcagagtgtctcccaacaaagtcattcaaggttgctaaggaaccacactggtgtttcttagaatacatttactctcatctccttttggacgtaaaaataggacgttcatggagacaaatgacagagtctttttaagatagctattgtctttctcttcccagtactgttttatgtgtggcatgctgtctttacaccaaacaaaaaaaccgagctgccagcctgtggaggtcattgctggggagtgggatcctgttctgtagctctgatatggtgccttttcataatgcagcgtgctcacatctccacgatggagtaaacaccgtctcaccgccaagagcttgaatatttgaaaaccaggccaggggttggctctggaatacagatgtttgatgtgagaattagggacaatttttgcttagaggcagcatgtattaggtcttttttctttgagtgtaatgtgacaacaggaaagcttttttggcgcagctgtgggcaggtcaccacagctgtggaaggaatatagacccttccaggttggggctaagaagaaaaacggcaacttttctttttttgagacggagtctcattctgtcacccagactggagtgcagtggtgcaatctcggctcactgcaacctccacttcctgggttcaagcgattctcttgcctcagcttcctgagtagctgggattacaggcatgtaccatgatgcctggctaatgtttttggtatttttagtagagttggggttttatcatgttggccaggctggtctcgaactcctgacctcaagtgatccaccctcctcggcctcccagactgctgggattacaggcatgagccaccatgcccggcccaaaaacagcaacgtttaaaagtagaatcttggccggatgtggtggctcacacttgtaatcccagcactttgggaggctgaggtgggcagatcatctgaggtcaggagtttgaggccagcctaacatggaaaaaccttctctactaaatacacaaaattagctgggtgtggtggcgcatgcctgtaatcccagctactcgagaggctgaggcaggagaatcgcttgaacgcaggaggcggaggttgtggtgagccaagatcgagccattgcaccactctagcctgggcaacaagagcgaaactctgtatcaaaaaaaaaaaaagaaagaaaaaagaatcttaacagtaatggtcagagcattcagaaaaaaaaattcagctgtgtcacggagtcagttggcttggcagctgttacaatatgatacaaaattttgcagaggcattttgtctttggaaaaatcatataggggactaggtgtacagtattttcaccactgcagttagaaatgtttacagttgtacctgatagctccagttgaataaagctgttacgctggatgatattgataacagtgcttaaacttctttttcaattcttgaaggtggccattcccatcgaggacgttaaccgcagtcaccttcggtttaccttccgccacaggtcatcacaggactgtgagtagtcaagcactttcttcccccaagtatttttaagggagaactgggggaaagcgcgagaggccactctcagttgttctggaactcgctatcataacacaataaggctcatttcccaccggaacctattccttggaaacattcttctctcttttccttgagcagatctcaggaggagatcttaatttccttctccagttcctcctacccagtgttgctggtccccttctttcttttgctttccagtcttccgtgttgacttgccatccatccatgccatccatcagaaaagttactgagctgtaacaaatacctctcaaacatgggctcttaaggtgcctgtcttagaattggaaatcttgaaccctttttgtcttccttggtggcccttgctgtctggagctcagggatggcttttctcatagacatttttgtgaatactgaccatggtgccaagactttaggaggaaagaactgctatttgaatcactctccttcaaaaagaatttattattgatgactgaaatttgttccatcacattttgttaaattaattgtcaactaaagctgtagccctgtgctagacagtaagatatcacagaaggaaaacatgattcccgtctttcagggtgtgtgtctctttggcattgggaactgagacatattcatatttgggacaataaatgacaaagagagttggctacaggcttgtgtgccgcaggcagttaaaggaaaagagtggtgtggagggcagaccgccctttgtcactgatgaccccgtgggggtcacaccgtgcagtgggcagtttcaggttctgtgtgctctggatggagcttaagcatgagcctcttctgtatcttcatttgaggataagaatacctttctggctggtgccgtggctcacacctgtaatcccagaactttgggaagccaaggtggaagattgcttgagccccggagtttgagaccagcttgggcaacacagtgagacccgatctttactaaaacagttatcctggtgtgatggtatacctgtagtctcagctgctcaggaggctgaggcaggaggattgcttgaacccgggaggcagaggttgcagtgagctgtgattgcaccactgcacttcagcctggggaacagagtgagaccctgtctcaaaaacaaaaagcaaaacaaaaaaaacattaaaccttcctcctagggtattcttgaaggtcaggcaaggtggaggctggccaccttctggcacgctgcctggtatggataggggctccattgtagttgctgctgctggaataatgtgttcattcacctgactatttctggggcctggcctgccctgggccctccatgtggggtgggtgtgcctggacaggggggctgcaggagagcagcctggagagcaaatgcacgagcacggtcatgatgttatggtgtgcagatcatcgagaagcttgggcctgctgttgttcaggggagttggagaggcctggtgtgtggtctgcagagctggggtgccggcccatgactgtcaatggcagatgtgtgtgtggtggggcccggcctgggatgtggctgactggaggggtttcaagcagcatggagtgcctggtggtgggtggtgcatggcgggggagtgcggggggtgggtggtggctggcagctgccgaaagcatcattgcattcctgtcctgtcccaacagtgcatgcaggccaggggttcagttacaagggcatcaggtttatgtctaacgggagaagcaggggcaggaaggccgccagcttggaaggcagttccctgccatctcatccttgccccaggatcagatccaggctaccagaccccagaccaagtcggatctgctaatggtgcacaacatccttggtggccgaagctgtaggataataacaactatcagcagatgttggccatcgttcactatgctcttatcatgtgcccgacacaagaagtttattgtgttatttggattcgtcctcgcaagattcccatgtggtatcagtattattacttcccacattacagatgaggaaactggggcttggaaaccccaggtcaggggctgaaaggcacccaggtagtcagtggaagagctttggttctaagccaggtccttgtgcccgagccttatgctccaatgccttgggggagtggcgaggccacttctttcctttggcttttattgagttcctgctgtatacacaacaagctgctggggtttctcctcttgcagagcttaggtttgagttgaggtttgagattagtttgcaagaaccagctagggcgtggcagcctgtgagtatcacatgaattaggcagaggtatgatgtgagcggagggtgctggtggaatgggggtggctgtgggcacaggtgtgtcctcgaccaaggcatggagggcatggtgggggccagcctagtgggctgcagtgtgccccagaccctctagggctccacgcatatatcaccttgaggcccacggaggaagcaggttaagaacggggttctggaatccacagaggactcgtctcaaaattacgctcccgtcttttaacaagctcattctctctaattaataaattacactagggcagagcgatagctcctgtagcattttaattttcaaaatccttgtttttcttgtcagttttaagtactcattatagacaagatgctatcacccaacataccaggacacatctgcataataaatgaagtctccgtggccacagcttgtgggattttggaaacatgttgagcatcgcaggtgcgatgccgatgaaagcctggatgtcggccgctgaccatggccttcggggcctccccagccagccctgcatgcagatacctggggcagaaacaggtagaaagagctgaggccacattggtccccacttgctaccctgaagaggaggctagcaaagggaacaagtgatgggatttctcacctgggatctgaccttgggattggaaagtttggtgtcgatgggttaacataatacctttccagcaacctgtcggcaactccagctgcaccagaccgtgtggtccacggagccaggcagacttgcagctctcaggcccagctggccaggagctgagttttccttgattgtagtgggcttgttgggtagggcggcctagagaatgggcagctctacccacactccagaacacacaacccctactgctgttcctaaggttctgtaaacttgtcatataaaccatccatctcatgatggctgctagtgagcatgcagtaaaaagcggtccattcctcggatgtgaagatgcagaatgttaataaaaggtgcacttactgtactacttactggtagggtcagtagaagccttctgctgaccattattgtcacacatccttctgaaccctggctgttttcctggaggcatgtcttttttgttgccgttgtttccaagtccacccaaacttaggaggaactgttctgttctttgccatttgaacattgaaatatttcatgtgctctggtgcccttttacagagttatttttttagaatcctagggtacatatattttacttctgtttcttcctgtgttttttggctggttgattattcatggaaccatttaatttgccaggatgtattgagcacaaccaggaaggcaaaggtgataagccatgttgtcttgggtagtgggatccgacggtaaatattttgagccgtggactcaaggcgggtggatgtgtcattctccctctctgatctctgtcctttcatctataaagagaaagctcggaatctgtaattgtagagatagtttccagctctggtcctctgtttctgtgctctgctgggattgcaacttgaggaatttctggcagatccatttcttcagtccatgttcctcatctgtcctggcttatcagtccttccccgcctttggccctcgctgtctgtcaccagccacactggacttctgtccccagatgtgccacactggtcctcgtgagggcctctgcgctaggtccccctcttcctgcagcattgacatcttggcttatgtgctgtccagcttctcagagagatgtcttctgactaataaattggattgtccccgttgtcactgtgaccccttaagaaaccacaatgttttgttttctatatcatctgaaagctcatttgtttgttgactgtctcccaaagtggcacaaatatggattgagtacctgttgggcaccaggctctatttcatgtactaggaaatggcagtaaaacaaaaggtcacttacattccagggtctagtggatgaaaccaacaataaatagcaacaagatcaacaagattctctatcaatctatctctatctctgtctctgtctctgtctctgtctctatctctatctctgtctctctgtcacacacacacataaacacaacatctggtagtgataagaattatcacgaaaataaatcaggtgagaggaaagagggtgattgggtgactaatgggctattttagacaagatatggtcactttggaggaggtgacattttggcagaaacttgaatgaagcgagtgagccccacatgcagatacctgggggatgaactttctcgccaaaggcagcacaatttcacattggggtcgttagtccattggtaattcacatgatggatattgcaaggcaggaattgattttagttttctgtattgacccgcagtttccttggtggaatggtctgccccttcccagcctctgtcgtttactgtggcctcttgtttccaggccctgttgatttccgctggtctgggcgtcttaggttgaaagcacacagtctttctcattgtcattttacagttactctcgctttctagtgttgcgggctttcctctgccttcttcaagaccatgctgctcttcttggccctttatcctggaatccgttttcacgttccaggaaaaatctcttctatgagattttgattagaatggctttgaatttatagattaatttgagaacaactgatccctttatgctaggagtcttcttacttgtaaacgtggtccatttttccatatatttattagattagctttaatacctgtttgtataattttgtaattgttttcataaaggtagcctttgtagcttcttataatgttattttgtcatgataattgaaagcaatcatcaatttttttgttttttgttttacagctaaggataaatctgagaaaatatttgcactagcatttgtcaagctgatgagatacgatggtaccaccctgcgagacggagagcacgatcttatcgtctataaggtatctggttgcattggtgcaatattgctgctatagacagtttcagtcttttctgggctccctgacctggaccaacctttcccatcattgtgaggaagctgctatctagctacatttaattatgcaaatgaacatttccaatgaccagcccttttgttgttcctaacgggaaaagatgatatacaatataacaataggtgccatctaaaaatgccgtgaacatgaattatgctgcagtaataagggaaattattaaaatgtgtatttaatatgatacaaagcaattacgatggttacaaggattagggataacaaagggtggcaaaaatggtgtgttgctgtttgtgaattgcctttgacatacggcatgactaaatccacaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacggtgcgttcgagaggagaaacacactcaccccaggagctctgccccagtcctgtcttttccatgctccttcctatgtggaggtgtgctccgtaggtgcatgaacgtcacccataaggcattcattgcatcgggctgtgatgatttatcaatgcatagaaggtggcatttgttcatttgttgtaatttaaaattcacacttctactctggtctaagggttattcttttatttttatttttattttttaagacaaggtctcagtctcgctctgttgcccaggctggagtgcagtggtgtgatctcaactcactccagccttgtcctcctaggctcaggcgatcctcccacctcagcttcccatgtagctgggaccacaggtgtgcagcatcacgcttggctaattttatttttattttttatagagatgaggtctcactttattgcccaggctattcccaaactcctgggttcaggcaaacctcccgcctcggtctcccagagtgctgggattacaggcacgagccactgtgcccagctgtattactcttaaagggagataaagcaatggatttacttcttaaaatgatttttggccaaaggaaggtagcgtgacataaaggaaagtgcacaagatttggagtcagactaaaaacctggaatcggaccatagccctgtgttaaccctggggatgcccttcaacaagtcttctgcacatttctgggtcttatcttccttgtctgtcgatacgggaatagtgcctgcctcaaagggcttagtgagggttacatgaacagtgggctgggagctcacctccctctttatgtcttccccattctcagctactctctgagataattactagttatctttatttttaaaagctggtttggatgttactttctagccctactcgtgctgtgggataaggcaccccctgctgactcccacaccccaaagctcagccctaatgtggcagatcactcatccatcagctggtgccgtgcccttgtgtggggtttggccgatgctttgagtgcctgcaccaccactgcttgcagcctctccagtgacattgctgtccagccaggggtacttcttattcagagcacactgatgttgttgctgtcactccgtctggaagaggcagaaatcctacatttaaaaattgaatcttccaaatgcagccgtatcacagctgtgcagagtgactttatgctctcttgaagcagagcttgaaaatccaattttttcctcttaactgcccgatacagattttgattattactgtctgttgctatcatgagttgtgtctctgggggattgtccgtaaatcatggcagtagttttggatttgcccaagggacagtcatcgtttggactttaataggataaacacaggacaaaagtaaagccattgtctggaagtcaggacattgtagtggagcgtgcactgagtgtgctgcatgtttgggcatgcgagccctgggtcaaatgcttttggatctttccgtttctgcactttgcactctgttgttctgggctacactttcccactgctggtctgctgagtaaactgcttggtgtgggagcagtaagtctcttaagtgccttaagcctactggggcacttttatattccatttgcatgcatttctcgaaccatttatgaagggtcctagcttgtggttgtgtagtggtctccatgagcatatgaaaagccttacctgggtgtgggatctatgcagccgtgcagtggggaagggagagaatgcacagggagcctgctagtggcatgcccgaggcatgtgcagtgtatttgtccctgttcatgctgctgataaagacatacctgagactgggcaatttacaaaagagagaggtttaatgtacagttctgtgtgactggggatgcctcacaattgtggtggaaggcaaggaggagcaagtcacatcttacgtggatggccgcaggcagagagagagagaaagagagagagagagcttgtgcaggggaacttctctttttaaaaccatcagatctcatgagtcttatcactctcatgagaacagcacaggaaagacctgcccccatgattcaattacctcccaccaggtccctcccacaacacgtgggaattcaagataagatctgggtgtggacatagccaaaccatatcatgtggtcagcagtgcggggctcaacttgggacttggttatggaaaggatgctcccctgtgacatgttagtctctggatgtggccttgatagctccactcgcctgacagatgacagcatccagagcctaatttaacccaaaggtgacatctccaggtgggccacactttagcatttcagtaggtgccatgtgttgcagtgctcatggtgcaggaagccatcatctcataattgggtcatgttccgaaagcatgctcggaagtcattacttaacttgctcatctttccccattcaaagcaatgctctgagctgcggttaggtgatgaggcccatccacagaatccttcttaacccttatgaccctggagaaaggggactgtggaccaggacatccccccggggggtggggtcagtggcaatccctcctttcaccctcaagctccttaagtctcaccagctgcagagtaatcccctccccagactgagggagagggcaccctgctctcagcagcagctgttgccaggcaacaaggaaattccgatgtgatgccactcaccaggactgatgggaagtctgcctttcatttctcaccagccacggttccccttcttgggattgtggcatgtcaggtgtgtacaagatggagctgccccaaatggcgtctaagcatcaactcccacattctcatttgagggaatcatttttctgaaaccatgatttgttcctgcgaagttccattacttagggaaacgcagtggctgaattattcattgaggttggtattaaacttctctgtcctcagcattatgctagatgctgtgggggatatgaaagaagtacaagatgtgattcctcttctcaattaactgactatataattagaaaggagtcatgaatatgggctgtgagtcccggtaataagggcctggggtgggactcatctgccttgggcagcctcatgggggctggacaagccctgttttcttccagcactccctttgctccaaggtgttttactactcattagcccaattggactttgtctcaaacttacaatacagcgtgccaccaactttgaatgaaggggatccagattattactgtctattaaggaaatactggtaattcttgtgagatggaaatctcccttaaccctaggaccaagagtgtgtctgggcaggatggagccttttccattacttcactttcacttagaaatgaagacatgttgcccaggtgcagtggctcacatctgtaatcccagcactttgggaggctgaggcgtgaggttcacatgagcccaggaggttaagaccagcctgggcaacatggcgagtccctgtctctactaaaaattagctgtgcatggtggcgtgcacctgtagccccagcaacttgggaggctgtggtgggaggattgcttgagcctgggagttagaggctgcattgagctgtggttgtgctcctgcaccccagcctgtatgacagagtgagaccctgtctcaaaaataaataaataaataaataaataaataaataaataaataaaaaagagtagagtgctcaattcgtcatcctctcctgggatgactgctgccatttgtgctttggactaggcattctgctaagtgctttctacacgtcatgtcagttaattcttacaaccaccttgtgaatcaggcaacactgtacccatggttcagatgagaacactgaggtgaagttacctccccaggccaagtggttgctgcatgctggtggttaggcccacacttgggcgtcttccacgggatctttgggtgctccttttttgtctccctatttttaactcttccctttgtcagctgtacttgttttggagcttattgcctgcatgccttttgtacaatttgatgctgaagttataatggatgtctgtatttcctgattttctacctatagtcacaattagagtttgttttttttttcttcttcagtattaactagagttttgttttttgattctttcttttatggagacagtttctgtagctgaagttggttcatgagcataacggtaaattagatgtactttgttaatggtattttttcgagtaatgggatgttaatataacttcaggtgaaacttgggtaggcatatgtactttcctagagagcttttggatcctgacttcttaccttaaagaatatcttgggccaggcatggtggctcacacttgtaatcccagcactttgggaggctgaggcaggtggatcacctgcgatcaggagttcgagatcagcctggccaacatggtgaaatcctgtctccactaaaactacaaaaaaaattagctgggtgtggtggcgggcgcctgtaatcttagctacttcggaggctgaggcaggaaaatctcttgaacccaggaggcggaggttgcagtgagctgagattgcgccattgcactccagcctgggcagcaagagcgaaacgccatctcaaggaaaaaaaaaaaaaaaagaaaaagaatatcttgatgccttaaacaaaaacatttctggacactgtcttcttccacattgactctttaaaaaccagtatattcattccttgctttttctatataaaatgcaacaaacaaaaacacaaccataacaaccacaaacttctgtggaagcccagacatggtgagggccggaagctcactcagtgcaggcgtgaacctcagtgcaggcgtggtctcagttgtccagagctactgtagctgtggggactcttaaccttgcagtctcagtactttaatttgtgttagttattttatttatattatctataaaaaaatagcagcttgttcttgagcaggagaaacaaaccatttggtatccagtgcctgggcagcgctttctgggtgagcaggcctcttcaggccttgtggtgctctgaaactgccttcctgtagaatggaaagacaagttcttttttagtttcccaaatgcacttttaaagcttctacatggaaatcatttcatggtaaatgtcgttgggaataatgaattcaagtgtactaggtgttaagtatgttgctacaaaggaatggaatatttagcaggtgaatcttttaaaatagggttgatttctctgttcacaaaattttatagagaacctcacataatgcatgattaacagagacagaacagagtttcttgcttgtgaagatctgattgtcattttctgtttccagtggaccttctggggctcttgaaatggcgctccaacaccagcctgctgcagcagaacttgaggcagctgatgaaagtcgatggtggtgaagtagtgaaggtaacatggagcccaaagggactttttgggtctttttttttttttttttttaatgtatgttaacagaagtaggcagtgacttcaaaggtagtataggattgtggttatactccctttaaaaaatagtgacatagggattgggtgcggtggcttacgcctgtaatctcagcactttgggaggccgaggtgggtggatcacctgaggtcaggagttcaagaccaccctgaccaacatggagaaaccccgtctctactaaaaatacaaaattagccgggtgtggtggcgcatgcctgtaatcccagctactcgggaggctgaggcaggagaattgcttgaacccaggaggcggaggttgcagtgagttgagatcgcaccattgcactccagcctgggcaacaagagcaaaactccgtctcaaaaaaacaaaacaaaaaaatagtgacatacacctctaggtgcacagagtgcttcttggcttctggtttggggggactctctgggttagccgtgaaggggactggctttgcaatcaacctcatcgtgggttctgcgtcctcttcccataggtcctcactacaggactcacaacagttcagtgacctctttaagcctctctttcccctgccatgagaagtggggtaacagtagtgccttctgcagggtcgttgtggagcctcaggtctttttactgttgtcatgatccttgttactgccatcagcattcgtactagactccctgagatcccctttaagtgaccaggagaggtctgtggtgtggtagaaagatcacgacactgagaggcttgcctgggccgtcttcttcccacgggacgctctgcagcagtgtcgggtataattattcattcagacccttgtggcctcagcatctttatctgtgagagagggcagtcagattacatggccggaggtcctgggagcactcagcttctggaattctttactctgtaattgtttgtggttctgatgttttctgcagtattaggctcttctctgctctcagataccccacaatttgctggggcaacttttccttgtacgtgaggaagcgaatttccatttttagtcgattctgtttttggctatgggacgataagggggtcactggcatgtggcgttctataagcatagactctccagcaaggtctgtgtgttgccgcctcagttcctcactctctaggagaggtgattgcagaaagagacgaccttatctctgtaaaaactaattacttaaaatggccttaattaaccagcagtgtgcttcacttcagtatcaattaatttggtcgcaccagtttcctgaatcgtataactcttcagacatatactcactaatcttaaaattttaatcatcttctcagtcctggtgttctcccaatggcttggacaatgttaattgcattttaaacttccctgtgttctgtaaattccctaattcaggtggaaactaggtgaaatacatgaacgtagttgagaagaatccagttaatgaaattttgtcctctttcattttgaagtccctgtatcatattaggaatgagttgtatttctggcgaccagttaccacagttacctggaagaatgtagaatgatcttgtcccgtcattctcccccattcccctcatctcatagattctcacatttgattattcatccctagacatggcctttacacctttcctttcttcctgtgcgtgctggtaccacgcaagcctgggtgacctgtccagcccttacctaccttgcctaactttgtgctttttctctgctggcgtgtctgacatgcgccgtgagcctagagagtggaactgacttgaggccacggggctgttaatggccagccaggacttgaggaattcctgcctgcacggggctccttttgctgatagggatgctgatagattgtgggtttggttccatttattcaggacctcccttctgagtattgatgactgatagcagagagatggcattgcttggtagattgaggaaggtatttgtgtatttagcaaaagatacgctgtcccattagatggaaaatggaaatggtgactttggtgcccttgaacatggtcttagagagagggtggggtgccagatgaagccctttcatggctccgtgtgaaggccctccttcaggtgctcgcccctgccccactgcagctccgcagcccaatacgtgcagctccatctccctgtggttctgtttctgtgccactgaccatgtcatgtgtctgggtgggaccaggtggtctacttcagggactttgcatgaaccgtgacaggccaggtcctgccacctgggagcctgttggcagggaaatattcggctgttagcagatggcatcaagttttgaccttcgcaaagaatctacattctgaaaatgatgggaaatggtgcaaaagtaacaaagtggtacagatccacatagttaggagttgattaatcccttgacatccagaccagcatgccttttggtcaggttggttttgtttcccactgtttgcatgtgacattttctggtataaagtaagtggtggctggcacagccaagcatggagaggattttactccttaaagggtctctgatctcatgctgggcatgctgggcgtcctctctcccaaaggaaacggatgaggctcatgctgggcatgctggacatcctctctcccgaaggaggcgggcgaggctgttgctgctgctgtggttccacagcactcctttgcgagcaggagtttgtggtttgcttctttaatcttggggctatagcagtttgagatcttccatgccatcccaaaagccccctgggtgttgggaagaggctgcacagtccaggaggaatctgaaccaaacacctgacccagcctttcctctgatgtccttgctgtgtgatcacctcacccatttatttttatttttctttaaattacagtttcattgagatataattcacataccaaaaaattcatccttttactctgaagtttttagtgtcttcatggagttgtacaactattaccactgtctaatttcagaacactttcatcatcccaaaagaaaccacatagctattagtagtcactttctcctcttcctgtaaccactaatctgcttcctgtctcgatggatttacctgttctggatattttatgtaaattgaatcatacgccctgtggccttttgtgtctggcttctctcacttagccttgtgtcttcaaggtttattcatgccgtagtgactatcagtgcttcacacctttttttgttttgagatgaagttgtgctcttgttggccaggctggagtgcaaaggcgcaatctcaggatcttggctcaccacaacctccacctcccaggttcaactgattctcctgcctcagcctcccaagtagctgggattacaagcgtgtgccaccatgcccggctagttttgtatttttagtagagatgggggtttctccatgttggtcaggctggtctcgaactcccgacctcaggtgatccggcctcctcagcctcccaaagtgctgagattacagatgtgagccactgcacctggcctgcttttatgcctttttatggccgataacattccatcacatggatagaccgcagattgtctttccattcattagttgacacacatttgtattgattctgcttttttggagatgatgaataatatttgtgtacaagttattttgtgaacatatgtttcctttcttttggagagatggccaggaatgaaactgttgactcatatggtaaatctgtgtttaagtttttgaggaattgtcaaacagtttttcatagcaattgcacaattgtacatttctaccagcagtgtgcaaggtctccaatttctctgcgttcttgcccacttcttattagtcatcttaaattgtagcccagatagtgggtgtgaagtgatagctcatgatggtttccctttgtatgtccctaatgagtaatcatgatagatcagtacttcatcatgtttatggccagtatttcgttgtgtggcgttctgcctcttcttgaccttctcttctaatacgaatcatcacttccaacaccgtgatcttcagtccgtcttacatttcctgcaggggaggatggggtgggacttgaagctgacttgtagtgtgacatgcctttgaagtctcttcctaattacatgtatgatgctttgtccttctttgcagtagtatttatttggtaaattttagtcaactgtaactgtaatttcgacattgttgttgaataaagtaagcaccttctggtctcaaaactgggatactgctgtgtattccagtttcagaatcacgatcctc

SEQ ID NO: 171 - DNA, 60060 bp, Homo sapiens
aacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggtgagtgtgtgtgtgtgtgtgtgtgtgtgtgtgtgtgtgtgtctgtgtctgggaacggagagattgcgcgcgagtgtgtagatgaggggttggtagaggtgagtggcgctggcaaggaggctggagaggggggcgtgggtgtgtctggcttgcagactgggtcgggaacgggtgtggatccgagaggctggtggcgcttcagtcccgtagcacacacagggcggtgtgcatgtgtgagtgtaagcgtgtgtgtggggggagggtccagggtgtgtcacagtgcaacacgcgagccggagcaagtgtctgcgagcgccactgggcagggtgcgcccccggaggaacccgggattggcgcatcggcggcgtgggagaagtgacctgggcgagaggggtctcgcggacatttggcggccccttgagctggctggagctaggagtggcgtcattttcgcctccgcccaccctcccccgctttcctcccctcccctgcctctggtgctggccgctcctgccctccacgggggaaaacagctggaattacttcgacgttcctgggggatccgccgcggtctctgattcagcctcgggaggagatttcgggctgggcttggggaatgcggctggttctgggggaaacacgctgtcacgcctctgtcaaattagtagctggagctgggatttagtgggtcggttccttacccacccctcccccatatcccccgcctgttgtccctgctgtccctgggggtcctgaacagcacgcctctgtggcttggaagtgggagatgcctggcagtgggtgggggaggcagggcccttggttatcttatgcccatccaagaacaccccttcctcacggacgctgggggcacttcagtttgtttggtttctttaagctactgggaaatatctaatattcagaagtcagccagtggccaggcaggagggcggtagacatccttataatacccatcagctgcacgggaccttctcctaagctgcctcaaaagaacatatctaaatacaaaccccctgttcttgctgcagaaatgtagtttcaaggcgaatttttcagtctagactcttcctgttgagaaattctggcgttcttattgagtttcacaaatgtgattgaaataagcaaggtacagagggggcaaaccccagcgcctttcttggaagggctgccttctggtggggaagacacacggctggagacgcagaccggttctgtgtggtgtgtgtggcggcagagccagccccaggctggggtggcacagtgtcggggatgaaggaaggtgtaagggagagagagggttttggtgtggatggaaaactgggtgttcccctgacctgtgacttcttagctttgtgggaccgtgtctcccactgcatctgggcaaggaggaggatttgcctgccctgccctgtaacctggcccctggcccagcgcctggcaggtgggaggagttgaaatatgcacatgggatgaagtggatggctctgggtcttctgccccattctcctgtgaaccagcaggttgagtttcgggcgaggtaatagactgtgcatgggtggaggtgttggcttttgcttttgagggatcctggagtgtctgtttgggtctcttgtgaggaagttcttttggagcaacaaagtttgatcatttggaatggaataaaaaactcacacaggacctacctagtccaacttctttccattttacagatggaaaatgaggcacagggatggggagggatgtgcccaggccgaactgagctggagctcagctttgtgagaggctcctgggtgggactgaaggcagtggaaagggttcctggcaggattttgcctgcctgctatggaggggcgaaaggaaattgcatcttcattgaatttctggtgaggaaacttttgaggccaaaggggcagagcggaatgattttttttaagtgtaaatcaggtgttcttgagagattagcaaagccagcctgaagggcaggggcttagaggctgcagccccctgagttggcctttgactgaatggggctgccccccccccatgacagaagacagatctcaactgagctgagggcccccctgggttacgttgaaatccgctggcctgaacttgcctcctcatggacctgaaagaaagatagcattgtgtttttcgggtggcccaaagctgcagttcttccttgggacccaaccccagagaatcccattccagatgtgactcagaggccttgtcctgggagagaaagcgtgatgactcagcatctgagactcaagcagggttcaggtttgactcagcctggaaggaaggccagggagggacacgacatctctctccctccagagcagccactgtctccctccatctgccttcatcctcgcaagaacgttgcctggatcgtattgctccattgaatggatgaggcaactgaggccaggagagtttcaggatttgcctgttgccatatggctcaggtgggagagccagactttgaacccggacagttggacttcagagcctttgttttttttccatgacaacatgttggggcgcctgaagaaatcaggctcaaatgaaaaggcagtcaggagctccatgcctcagtttgcttttctgtaaaatgagagtaacagacatgatgccatcagaatgtgtaaatattaatctgtgtaacctgagaacagcactgagcatgtggaaaacagcgtgtaggtgtttgccgtcagtagcacccgcagaagacattctcaaggcatcttcttggcaggcagagtctgggaccctttgtcctaaacctacccaaggctgtgaaagtgcctgcaaatgcttgacctaggtattgctttttgctaagcttatgtaggttgcataatagtgtcatgaaaatcttgtctgaaatgcacatttccaggcccggtctcctgcgattctctctccatcaggggatatgctgttgtttcaaagctcctttggctgggttgggaatggggtatcctgcaggcagacagagttgagaacctctgctctggaatgacaggggagagaagaaggaaggtgtagtcatacatgccgctgtaccttcaggccaccctgtgtccacagtgccagggaattagtgagtgctcagtaaatagctcttgtttgctatagtgccttggaggttcaatgcatcacatcagctaactgaggtagaagacattctttccacctctcaggtcagaaaattgaggctcaggctggtgactcttctgtccagagtccagtgagtggggttctgcccaaggtgagcctcctgagccctttccaccctccaacattgcgcttggaggccacccacaccctctgggcccaccttttgagaaggagcttgtttcctggatccaccccaggctgttgttcctgcctcccttgatggctgtgtgatggaagtaccgcgtgtccacttgctttttatctttcaacttggagatagaggcaggctagatagcggtcttggctgagaacttagcccaggcaggtaggcagaagggctggggacactgaggccccacaggaaggcggctgcagaggtagagggccatgagtaggtgccaacctggagccgtgttctcggggtgggggccatgtgaaaagaaacctgggctccctcgggtggggcgtaagccccagcactacagaatgggaatggattacacaatcggggccataagcaggtctctttgacccagatctttgactttcccacctaacattgtttgcagacctgcctatgccctacctgcctgggctccatctctgaccttttgagtccagcgggttttcttgcaactgagctggtagaaagtgaggctccttaacagtctgggggccttgagtgccctccccagcagtttaatctttcctttctttaaatctgtggggagactttctgcagctatacattttaaatctgcatagagttctgtttgaagagaggtgggtgggggcccaggtctccaccttgttctcctgccttcaccctctgccccacccccacggaacctaagaagattccaagtaaccctcttcaaatatggatgtgagagggccatttaagaggtgggtctatggcctctctcagctgggaatgcttaccatctctccttcctcctttttaatcatggaactctcctcctttctccagaaaggcctccttggctgtcctctgctggaggggaggctgggttgggtccttcctgggacctgtccatgtctcccatgaaacctgagagcctgtccttagtaggtgttgtgttagtggtggtggaaaggacatctccactgattaaggaagtaacttggaccatcttgcatagacaagatcggaggcccattccggagggtggaaactgcaagaccattctggggaaggatcctgttagcgtggctagcatcccatctcgggacaaagggttctgtatgaggaagccatttcctcgtcctctgctaacactggctccgtttgtgtgatttccacaaattatctcagaccatccagcgcagctcatgcctgtcttgcaatttcacaaaataatcctctaaggagaccagtgtcctcctttggacttccagttattcacctcgtcccctcagacggtcgtcttctgtctgccaaacaaattactcgtgctgccaaaactccactgagaatctccaggaagatctcggttgtattgcagaaaagaggtgggccctgacgagattcctgacacctccctcttcctgctgttgtgtttgggacactcttgctgacctccctggtgctgtgctcaagttgaacacacagcagttcagtttcagctccagcccctctggacccacacccagggagtgaatgcggctttggcttgtttgagagggagacagtggggttcaccttcttagtgatccctttttcattccttgaatatcaaacatcactgatgcctcctgggtttcaggctccactgcaaagtacaggggccctcgaggagttcctactgtggttttgttctctgacatttgtactgtttccttgattctgattgctctgatacagttccctaacctctaaactagggaactttcttgaaggtccagtgaatccacccatattgtttgctgagttgattagttaagaaagacagttcgtgaagactgccaacttcctcaccctccccagggccttgagtttcagaagggccagaaaacaccaagagagcccatgaactgctttgtagcttgacttcaaaatctctttgggcaaagaaatgacaaaggattgtatccacagtaaggcagggctatccagggcctatctcaaggtggttttccttgaggttcaggcagaaatggtgctgttctcggcaattttctggggaagttgctacagcaaacagccacagcacatgttgattttttccctccttttaaaaatctgttctataaagagcacaatgtgctggagagaacactggctttcatgtggccttaaaaccaggcatgttacagagggtggaatctgggccagttgctgttggtgacaatcgatgctacccttgtcagcaattcccgcctgctctccctttatctgcttcactgaaggcctccaggggactgttgtccgccctcccccgagggaatgagtgccacacctgcacccacaacaaaccagtgagtttttcacctttccctcagtagggaggaatctagacatgtggcctttggaagtcaagtgggcctttgtgtttgtttttgagcctcaggttacccatttgtgaactgggtataatacccagcctctcccggggcaacctccttgaggagcaagtgaaacagtgtgctgagtgaatgcttttccaaagcattgagttggccgtcttaggaaggtactatgggggagctgaaaacagagaaccttctgggtgttgtgaagggagaaaagttcaagatgctggttttgccaaaagctcaagcctgctcatgatggctcagtggtgactgcagggtggaggagaggcatgtgactgtcccagctgacctccacacgctgaaagcctcatggtcacgtgcagcccaccttacaacgttgtatctgggccacgggtggtggtgaggactgtggatatatttagggcaatgtgagatcattgtcaacattccctttaaggttgctttaaccttaaagcagccagcttgatgcttgctgacttggggcacacatcttaacctcttgatgcctcagtttccccgtctgttaaatggtgacatgctggcacctccctcctagggtttctgtgaggcttaaaggaagtaccgggtttagagtccagttagtgccacagatactgttcctggtgctgtttttgtggtgtgtctgtgtagggttacattgttgccttcctgtggctgctcttcctggtgggcggaacctggaacttctagaacagatcatggatgtttctctgctggataccccttcagcctcaccctgtgggagttgtggcggggcccaggagagtttgctcaagagggtgtgcaggtgggtggcagagctggagcaaggcactagtcttaacagacaggagtctgaggctggcagaagtgggggccttggtccaaggtgcggggctaatctggccagagctgagcctggcagggccttggtaagaccctgtggcccttttgtcttggtgaagcaccttcctgcctgggtttccatttgcctgtaagtttgttgtggacagcgtgatctccatagacgtacactgtgcctactttacagatggagaaaccaaggcccagagaggaagtgacttgctcagagtcatggaataggaaagtggcagggtccccatgccctgattcctaggccagcgttcctgctgccccactgaggtttttgggaatcacaggctctgtgtgtccccctcagtcccccaggggctgttgaacagttctcaagtggtgtcggattactgaagatgcctctgcccactgccctcccaggtcccagggtcacgggtcacgttcttttcttcctcgggcagatcctggccttggctttgcctggcacctgtgatccagctctcctctgactctcctgggtctgctggactggaagggtatttgtgtagcccctcttgggccctcattactcattgacagacagtgctggtggagagaagggccccagtggtgacgcactgggcctgataatcagaaaccttggtggcatttgctgagcattttccatgtgtccctctcctcgctgggactctaggactgaaacccaggccacatcctcacagatgtcctggcatctccaaggcaaccctgaaaggaaagtatgttgatgaattaagcaactgtttgcttaattctccatgccattcttgaatttaagccccactgctgatcattgggagcaggagttagcatgcccattgacagacaagcaaactgaggcaaagaggttagatagccaggcatggtggcatatgcctgtaatctcagctactcaggaggccggagtaggaggatcacttgaacccaggagtttgagaccagtctgggcaacatagcaagaccctgtctctctaaaaaacaagatgaataatacatttttaaaaagagattcgataaattatgcaggatcacagagctaataaatggtgacaccatggcctgcaagccttcccccagctcctggctacctttcgcttctctggcattggtcttctcggaattcctcccaggcaggtggatgggaaaagaagtgaagatacaggctggcagctggtgctgtgacctggagccctgtttttggtgctaagctgggttttagctgaaggagacctgctggaggggtttcttctgtgcttcttggggagcaaagatggccttggagatggagacacggtttgtcagtcccaagccactccaaaggtggggctggtgggctaggagtcagccctggttcccccgccatgctgtgtgtggccctgccttgccaccccacctgctggaggacctctttgatgctttctagtgggtcccaacattctgtgattaggactttgcatgaggcagagggagggcaggagctggagtccagcaaggacctcaagcccagggacaggctccacctgccacacttgctaagccgtgagggcctcaggtgcccgggaggagggagcaggagtggaagcaccagctcgagccgccaaaccaggtcacgtatcacctgccatttcctgctggcagaaggagatcacagacaccagaagacagcagcttctgccagaactgggtccttccatgattctcaggtggtgactttgaatcccagaaaaagtgttttggggagagtggagtgaaggaagagtgtgaacattggatctgactccactccagcccctgtgctgcagccagcagggtgagctcaggacagctggcagccgcttgggcccagccccctcctccgtgaatgaaggtggtggggagtgcacgtgtgcgtgtgagtgcgtgtgagtataaatgactgtggatgtgagagtccatgaaagtgagaatgtatcagtgtgtaagaaagtgtgagtatgtgagaatgagtgtgtttgtgagaatgtatgtatgtgtgagtataagtgtgtgaatgtgagaatgtctgagtgtgagaatgaaagtttgcaagtgtgtcagtgtgagggaatgtgtgagtgcatttgagagtgtgtgtgtgtgtgtgtgcgtgtgtgcacgcatgcactagattaaataagaatgcatccaactgacattttctggatactgttacctactaggaattactaaaatcagctattccagaggagggtggatgtcgcaccaggggacatttggcaacgtttgcagattcttttgctggtcgcagcgtggggtgtatgctgtgggcatgtggtgggcagaggccagggatgctgctgagcctcctcccgtgctcagggcagcccctaaggcagaggctgcttgtggggcccaaatgtcagcagtgctgagctgaggatctctgtccaggaggcacagacgctgtcctggatgctgtccagacagcatctgctctgccctccagggggacagacagacagtggacacagcccagatgcagcctgatgagtgagcccaagggagtgcctgtcccctcgggactgtgagctccgtgggggcaggaactgggtctgtttgctcatgatccccagatgagtcccatagccagtctcatcaccatagctggtgttatttttgttctgagctctgtgttgggcacatagaacctagtgggtagaaacctctgaataaatcctgagttttccatcctgcttccgtgaactcagatgttctttgagggccagcctggtggcgtgggggctgggagtgggcagattgtagggagccaagtcctggggtggagtggggttcaggcccctttccctggcttgagccgaagcaccttggctttttaaattttaaaatttttattttttaacatttttatatgttgaacttccttacatgatttcctttggataaaagctcctgcaaaaaaagtttgaaaagttttttggttgaggcatcagggacaaggtaagggctgcttgatgggcccaactcgggagaactgaggtgagggagccgctctcctcccaccctacaggctggccagatggtggaccgccagcagctggctgggtcaacctgcagagagcaccttctgcagtccttggttcatgcggccttagtattgcaggacgcgaccaacatgcaggctaccccgaggcctgcagcccccacagtccccccagactagtgcaaagctttatccagtctcccggcagacttcagagtctaggacacttcctaaatggttcaaaatcaatggaatcatttgggggacaataaataatgtcactagacattgccaaatgtcccctgggagagaaaatcccccctagtttagatataccccgtgatcatcctcagcagttttatctctggacttcccaaaggcctttagcagtgagggggctgggtcagagaaggccccaccagctcccaaaagcagatgctcaagaacttgatatttctaggacacacagcgatttttttaacccattgcctcatgtggtctgggaagctaagctgtaggaataaaaaaggtgccgggtagggtaaagaggtttcaccagatagaggaaacggggaaggtggacatttctgtcttttctgttctggagaacgagagagctggtggagactgacagacactatgtcctaatgtgatcacggtttctggaagccaaagagaactgaccaaactgggctgaaccacagcatttctcgagtccttttaaatgtagaatttgttttccagacattgcactcttggggtttagcaatgatttaaaagtgaattttactgaaagcatgctgttgagctacattgctcatttattcagagagggagttgcagcctgactttctgcctaggagagtctctcgtgctgggagctagaggtagagaaaagaacaagctacctgcttgatgaagctcacagataggactgcttgaacccacctggtgggacagtgagagccccctgacttcaccctggcgcgctttgctgagcagggtatgctaagaagctcctgtgaaatgagaagtcctttcactcccagaatgaggggtggcgttggcagggccctgggtttctggaaggctccctaggccatgtaggcgaggtgtcccacaggccagggtcttgggaccacgaacctgctgaattagcaaggctaacagacgcgggcctttcatgcctcctgcctccaagctggcagctgcccaggaatgctcacaaatataaaaccgactttgttttcagaatgttctggagcatagactccaaagtctgtataaagccattcttgtggggctggttatctactggggaaaatcatgctggggccccagaccagagcaccccagtggagagcaggatctgcccacggaatgccatgtgttggcacaagggatggacccggggtggattcggggtggcccgcacttgccggctgacctctaagaggtgtttcaccaggttcttgggagttcctgggtcttcagaggagccctaggcaggaatttcagaggcttgcattctctcgaccattgcatccgaggggccttgggcagtgcggggcccaggttcccactctgaagctggctgtgtgagggctttggtcaggcgttttccattcagaaagtctggatctgtgaactgggtgggtggcctgggctcttccctcttgtcacttacttcttctccgccggtcctctgctgctgtctgtaagacttgaccttattctgcattttttatgcttcaccccagggattgatgggcatttagtttttctaacttgactactgatctagaagaatacatgcttatacttctggtttctagattcagctcttggaggcatgcttaatagatagcaccacctgcccaagccttgcaccccagggagtcagtggcagcattccaagtcttcctgggctgtgcttcagtctggttttgcagcccacacttctgcacctgccctgtgttagagcacaggtaacccctctggtccatcccctgctttgatccaggaagtgctttctgccttggaggtcttttttcttacaaaattgtactgtgcgttcaaatgcctgccaaactccttgacttaaggttttcctctgcccctcttcccttttagcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggtaagcatcgtgtgagcttgtgttcccctttcattgtcacacgggggctgcctgactttgggatcagcaatgcaggtccccttctagaatgcagtgagctgcatcctgggtatggtgggtgggcctgaacttggtatggggacctgtttgtgaggctgatctatccatttcattgggagggtggtgtctgtgagcctcagtatcctctcccaggaaatccactgcgctggccccaatgggaagactgggttgggtccatgggctgtgtgtacaagggacctcctcatcccctgcagtgcatcacgagggaggtgaagctgctgggcagagcgcaggcctggccttcttgccattggtcttggatttgcttcctttaggaaacctctcagcaggaagtgttgaccttttggcctttgtctccttgcaggcaggtgacagcagggacatgtctcgggagatgcaggatgtagacctcgctgaggtgaagcctttggtggagaaaggggaggtgagtggagatcttcctggctaccccatcacaggcacatgtgcacatagacacacacaggcacaccggagctcacacttgtacttatgggcatgcaaacactgcacaaatacacatgtatacagcatacacacggcatacaaacatgctgcacacacatgtacatagcatacagacacacatgcgtacacacataacacatttgtccactgcttccttgaaatgcaaagttgtgagaggctctggttcaagtcccataggatcgagggctgggccccttgcccacttctctgggcctttctgctctcatttgtaaagtgaagacatcgaaccagaggttctctcagctttcccgtctctaacattctgtggttatagaacatgcaacatggggcccagttgcccatagggactgcctgcctcagctctcattaaagccacatactctggggccgcactgtctgggcttaaatcccagctgtgacactttgcagcttggtgtccacttgctaacctctcagtatcttcatattctagttcttcatctgtaaaatggtgacattaggacttacctcatggggccaagtgaggatggagtgacctaattcatagggaacagttagaactttgccatagaggagatgggcaatgcatagtcactttttcacttgctattattatctttttgggcaaacctcttctgtcaacagagctcttcctgttggaaacagaagcccctgtctataggctgggctggcagggcccagcctgggctgattgttctgaagatgaatgaacctttacatttgcacagttgacaccgtagcttcaaagcatgtttacatcccaattctcacttagcctcataactgcctctgatatgtctttttaaaaatgtggaagctttggtccaaaagtgaagttagtctaaagccaactaaatgcttttaaaagtgataattaccatgcactaaccacatcctgcatgcctgcttctccgccgaccgtatttcaactttggttcatgcaggtcccaggttctgtgatcgtactcattttgtagaggaggaagttgggtcttagggaggttaatttgtcttctttgcatagttacaaagtgtgggacatggaatcaaacccaggccagcggacgttggtgaatagactgttcatttaatttccttatgactctacatgtggctgctctgttttaggttcataatttcatagacttttctttacaaatgtgtgaggcaaccatctcttttccccttttgcagatttaaaaataaaaacaaactggtcctagacaggaaggggattggtcaagttcatccagatagctggtacaactagagttagaaaccaagcctggggaggctacagatgcttgcttatcattccacactaaggtctgcaaaccttttctgcaaagggtcaaatagtaaatatcttaggcattgaaggccacatgacctctgttgcaactgctcaactttgccattatagcaagaaagcaaccatagacagtatacaagtgaatgtacttaatgtgttccaacaaaaatttaaaatgtggtgaggcggattgcagtgtgccaacccctactgtatactatgcaatttctaaatctgtgtcctctaaactctgggtctgtgacatagtcttctgaaatagtcaaacagaaacttctagatagaacaaatacatatcaccatattcttatttctcccttttaaaaaaccctgtgaaaatagtatcccacactttgctttattcacttgacatttctgggagatcttttcaacatcagtccataatccacttgcttttctctttttaggtacatagtattccactacatgtatttgcccagtgcccagtatatgaacacatgtgtctttccagccttttgctattacagacagcactgcaagaaatttgcacccttgtatctttcatgtgtgtcattacatacatgtgcaggtacagccctagaaaaaagttctcagaagtggcatcgctgggtccaagggtaaatgcatttaaaacaacattttttatttatttcgggcagcctactggaatccttagaacattttatgtatgaaacacatgtctaagagcttgcccattcagggttacatgccagtgcatctctcagtgaatatttaccctttctttcaaggtttagacggaaataaatttctttcaattccttagattgactcagcaaagtatttagagttaggcttgactattgggaagttcttccttgtgtctgtcctcaatctagattgccactatactctgatgacgttttgaaggttggtgtttgctgtacagaatggctttccccattctttcccaccagtacacactcacatgcacatatacacacacagggcaatggtataggtgccagccacgtttgtttccacttgaatttacccaaagtccctgatgttcttgcccacagctcaggggatgtggggctatttgaatccccagcacgagggcctgtgttgtcatctagtcttccaatccctgccatctaatgggagctccattccatcatcctgttcccctcatcgcttctgcatttcgctctgctgagccgtcttgttttctgggggtttgtggtgggtgaggctggggctcagttttcacagtgttgggactccatctctgggtcagtaggaaaacatgccagcaacatctcttagaaatgttggccagccaagactccagttggtcctccgagtcacactttcaccaggccagaggggacacaagacttttctctgtcttcctgggcctgtcctgccatggacagctctggtaaaagatagaatttgggctgaaactcagattttttttttttttttttgagacggagtttcactcttgttgcccaggctggagtgccatggtgtgatctaggctcactgcaacctctgtctcctgggttcaaggaattctcctgccttagcctcccgagtagctgggattacaggcatgcgccatcatgcctggctaattttgtatttttagtagagacggggtttctccatgctggtcaagctggtcttgaactcctgacctcaggtgatcccgcctgcctcagcctcccaaagtgctgagattacaggcgtgagccacagcacccagcctgaaactcagaatttttagattgagggaaatgcttagaggtctccactgcctcttctactcacaagagactgaaatttaatccaggtccagatgacagcagccatggaaaaaatgtaaggaggaccatgatgtggtcaggtttgagttttaaaagtatagcacatgggtggagccggggagaccagttaatagtcagatatcacatttctgtatctctcaagcttgtgatcagcttagaccttcagctttttatctatcaaggctattgtcagaaaggagtccagttaatgtgtctgcttttctgctggacttctattttgagatgaaaaggaaagtctcggctgggcacagtggctcacacctgtaatccccagcactttgggaggccgaggcaggtggatcatgaggtcaggaaatcgagaccatcctggctaacatggtgaaatcccgtctctactaaaaatacaaaaaataaaaataaaaataactgggcgtggtggcgggcacctgtagtcccagctactcaggaggctgaggcaggagaatggcgtgaccctgggaggcggagcttgcagtgagctgcgatcacaccactgtactctaacctgggcgacagagcaagactccgtctcaaaaaaaaaaaaaaaagagaaaaggaaagcctgcctttgtgaggaattaaggagaccccacaaaggaggaagtgtaggtacagattcaggtcatagaaaggcccatatgtcccaatattatttctcttacagagaaaacagatgaaattgacaattttttttgtcttttcacagaccatcaccggcctcctgcaagagtttgatgtccaggcaagtagaggatgtggctttccttccccttcctcatcccgtcttctctttttcctttttctttccattggtttaagtagatcattgtgcaaacattgcgggcaaggggagagaaggcagtggtctcagctaggtcctcaccctcagctgctgctcccagacagaagctgacttgagtgctggccaaagaatcaggaaccagtcacttcccacgaaagcaggacagagacaccgcctgtttcagtcccaaagagctggccagaacggtggggcgtgtgtggggaaaatggtgtgatgctgggctggcttgggaccctgtgaggggagggaacggaagcaaaagcttgatgttcttggctccacttgggaaactgaaaccagccttctctgtggtttactggcccagaactgaagtatctccattcccactcaggattgcagggtgggccagggggtgcacctcagctgtgtccaagaataggctctcaggagaacgggctgggctctctcagccgagggctgggtcagaacttcaggaaatctaagtcctggactcgttagccccaagctggggtgggtcccatgctgtgctggcctctggagggtggggcagaaagcctgagcatatggcgagcttgtggtctccttgaaggaggagaggcgcactcctggaccagccagagagccagaggtggctgaggtgttctcacctgaaccgctacccatgtgttgcacaggtgtccccagtttgggacccattctgcactctgcatctcactcctctattctacctccttacctcaaaacaactccgcttttcctcttgaatctctgatttcatgaatgctcccccatccatcccgaggcgaggaatcttgcactgtctttggaaggaaaggaaaggatgggagaggggctggaagcattggctagtagatgatcgaggctttctataccaccaccaaggtgtgtattttctcatcatcctggttgtgtcaggctgtccctagagatcaccctgacctcagtgtttaagaagaagggccagatgcagtggctcatgcctgtaatcctagcactttggaaggccgaggcaggcagatcacctgaggtcaggagctcgaggccagcctggccaacaaggagaaaccctgtctctactaaaaatacaaaaattagccaggcatggtggtaagcacctataaccccagctacttgggggctgagacaggagaattgcttgaacctgggaggcagaggttgcagtgagctgagaccacgtcgttgcactccagcctgggcaacaagagtgaaactctgtctcaaaaaaaaaaaaaaaaaaaagaagaagagagacagcactgggaagtgacttgcctggggtcactcagcagtgattggggaagtggtgccagactctgggcctcacctcttccagccctgagtgctccccttgctgcttgtgtaggttttaatgatgttggtgagggcttcttacctgccaggtgctgtgctgagagcttgccagccaatatctcatgtaatgcctcaatatctcatgataacaggagaggcaccattagctttatttttcagatgggtatactgaggccagagtggagggactgggagccacacctagctctgcctgaccaggaaggaagcccatgttcttcccgcaccactcatgtgctgaggtccaggcttctcccatgccctggccagagctccatcccgttcctctctatgttgcaggacgctgggcatgcgaaggtgctccaggagggtgggaggtgaatgtactatcttgaggtttatcaagtccaagccttcattttacagctggggaacctgagggacagagaaagggggaagtcactcattgagggtggcatggtggggcagctaagagttatggtagcaatcctctttttcaccctcctgagaatgggaaaaaatgcacccagggaagtcagagctgcaatagatgcagtggctgtggcaccagcaccatggccttggttatttgactggttctctgagctgagaacagctggaagttagccccaggggtcatctgctcattcagggatgggccgggccaccccagcctccctcagcctgatcgaagctgcccttgccaaccttccctgtggctgaaatgtcagctccttgtgttccccaggggagcggcttgctggcactgaggttgtatcttcctgcagtggggatgtgattgtccatcctcctcaggtgaaggccccattccagagccaggaagagtgaagcgcaagccccatgggtgccctttcctggtgattgacccttagcacaagatgcttcacctctgtttccccacctgtgaaatggagacagtgctccaggcttgttaagtggtggtggagagaggacactgacaagggccaatgatgtggtgcttcccgcatcagtgccgggccaaacatcacacaccctatccactaactatcatggagtgttttcccgaattatttttgctgttgtggaaacatacacgtaacatccaatttaccaacttaactacttttaaatgtacagttccgtcatattaagtacattcatattcctgtgcaaccatcactatcgtccattttcagaactgtatttatttatttttatttctgtttagacagagtcttgctctgtcatccaggctggagtgtagtggtgcgatcttggctcactgcaacctttctttacctcctgggttcaagcaattctcatgccccagcctcctgagtggctgggattacaggtgcccgccaccacaccgggctaatttttgtatttttagtagagatgggtttttccatgttggccagtctggtctcgaactcctgacttcaagtgatctacctgcctcagcctcccaaagtgctggaattacaggcttgagccactgtacccctggaactttaaaacctgcagaactgaaactctgtcccattaaacaactcctcattctagctttaggcagtcatccttctattttctgtctctgtgattttgattactctagattttgattcctctaagtacctcatacaagtgcagtcatacactatattattattataaaactgtattaatttgcattgatttgttctttgccagtgtctggctggtataagttagcatcgtgtcctcagggttcatccctgttgtagcaggtgtcagcatttccttcctttttaaggctgaatcatattctgttgtatgtatgccccacattttgcttatccatttgtccgttggtggacactttgggcactttgggctattgtgaatactgctgctgtgaacatgtgtacagatatctctttgagatcctgctttcagttttgggggacatatacccagaagtggaattgctagaggtatcagtccattctcaagctgctataaggacatatcagaaactgggtaatttataaagaaaaagaggtttaatggactcacagtttcacatggctggggaggcctcacattcatggcagaaggtgaaggaggaaccaaggcacgccttacatggcggcaggcaagagtgtgtgtgtgcaggggaactgccgtttataaaaccatgagatctcttgctctttataaaaccatgagatctcttgagactcattcactatcacgagaacagcacaggcaaaacctgaccccatgattcaattacctcccactggttccctcccacgacacgtggggattatgggagctacaattcaagatgagatttgggtggggacacagccaaaccctatcactggatcatatggttattttggattttaaaatcttggttaccaattctgagaaacctagaaagcatagtttatctgctccctgcgaagataattcctcacatttttgtttctctggaaagtctgcaaaacacttttacattctcccatctcaggacacaggcaactgacctactcccagggaaggtcaacctatgtggctcaggctggggtcggctaaggcgctgccccttaggacatcattaaagtgggggccacacagagaagcctttggaaggatagagcagaggtcaggataagatttcccagcattgtgcaccagcctgggctgagccgtctgagttaattccccaagctgtcctatgaggtcggagcattttccctattgtgccttcctttatttctttaacaaatgcccactttgtgcctggcattagtttaggtgctggggatgcagtgatgagcatgacaggcagtgacctgtgttttcaggaacctaaattctggaataatagctcagcactgccgagcacagaatgtgtctggcagcatgccaaatgtgccccacgtgtgcttacggcgatcctgtccccatcctacggagagagaggacctgaagcacagagaggttagggaacttgcctgagatcgcagagctggaaaggggacctcaagccatttgcttccagggcacatatttgaaaccaatcccgattcctcagaagaaagagtcaaacaaacatacaaacaagcaaatgtgagcattccagcttctgtaggtgctttgaagataacagtgaagggtgatatggagccaggtgatgggatagggcatggctggggtgctgtcttaggttgaggcttttttttaagtggtgacattgcactgaagtctaaaagatagatagagccagtcacgtgacaaagagactggggatagatcattccaggcagaggtaacagcacaagcaaaggcctttctgatctgaattctgaaatttccaagggcaaaaatgtgttattcctgtaagctgttaacaggctcagtgttcccagtaagtcacaatatttgagctgaaatctgagtgttgaatgacacttttcaaggttgttaccaaaagaaaatctttgtctaaaactgtattcatttagatttggcttcttagattggaaggtgttagggactcaagagattgatgaaagcgtcccccagattttcagcagtctccaaaatcttgggtgtagggttgctgtagaatttccttcagaagatgcagtgcagtgtgacgacggaagctctctggggcctgatgggttccagggccaggaactgagaaggacagagctttggtcaagggggcctacagggcgtatcagcccggggactggtcagcataatctgacctcagattcacatgggagttgcagcaaagcgacaggacagcacctgtctgccatgcacttcagtgtcctctgatgagccaggccagcactgagggcctcccacgccctcttgctgaatctttggggacctgtaccatcatccttcctttacagataaggaaactgaggctttcccaggggcggcagctgtgaagtgagccacattgagcccagggctgtctgacgtagacagttctctcaaccgtgatgcttgagtatagccctgttcctggaaaggctgatcaagcccttatggactagattgtggttcacctttgacacgtctgcttgtcaaaaaatctagccaagcagataatctaagcaacacttcattgggcttatgttcagcctactgacaatgagttgttgtaggactcaagagttgctgtgccttaatggcaaatgaattttatctattcatttagttggtttcttacctgcttgttaaaatagggctccctcctgggcagttcttgccctgggcatagcttccctcctggtccagtctaaggagtctgagtcgctttattttgtgtatctgaaagcagccgatgtcattccttgaaaaataattactgcttcagcactttgactaactcaggcagattcctacttcctttaccaatgtagtcaataatttaggcttttattgtttttgttttttaaatgaatcaaaacacacacactgagcccagagctcggcactgaggagctgctggcggagtctgcattgagctgctgggtggcctgtctctggagacagctcgcctgccagagcagatggcatcaggccttatctctccatcactggcatcgcctttaggcggtctctttgttttgtcctgggtgatgttcgggcaaagtgattggtgatttgcatatgaggttctgccagcgctgtcaggcccccacctggctctggttcctgaaaagattccagaaccctcagggcacggggtgggcgggctgctggcctaggtgtccgggttgcaggaaggacacggtctgatctggctcggctgagaggcctccagcatcaggttttaggcaattgtgtttgcagatttgatgagtagggagggggggagtattttgggttccagcttattttctttggctagaattctagagtccaagacttctgctccagttggagagctttgtggaaggccacctgggggagggaagaggaggaagaatgaatatttgcatactcattgtctcagggcttccctgctaaggtgaggggtgttggcctcttttgcagatgagagacccatttgaagatgttagggaacttgccaaagggtactgtagagatagtcctagacttagatccatctgcttccgaaaaatgttatagtcatggaagtcgtaatggctggcctctcttgagctctgctgtacgtcagaaaccgtgctgggctattttcctgcatccgctcatgtgatcctcatgaaaccttgttgagggaggtatccttgccatctatccttgccatccttgttttatgttgaagatacgaggcccagaaaatctggagggatttgcccagtgtcacgccatggtgagatagatggtgaaagctgattcaatccacacgtctggagccaaagttcatttaacgagttttggggaagggacagcagagttgacttcatcaccgataaattgtacctcgtgggccgagtgactttctgtggcttcaaattgctttttctgttggatttgctgcttctaattccctccacctggatcttgagttattcagatggttagatttgatttggtttccatgggaatctgtgtttgtgtgctcaccagggctctgtgggaaatgagctgatgtgacccacagggcctccgtgtggagtggtggagggggctggggcagcaccagggccgggcagggctctggaggtctggctcccgttctgctgcaaggcctcttgttcagcagagctgagctggtcttagggatgtacaatcccattcggtgggggggctgttttccctccttttcttggaagcggaccagctcacagggaaaatggaaatggtgaccttttgctaatttctctctttccacacagttgcttcttgttttcatgccccatgactgaaggtgggcagaactcagacagaagcctggaaatcctaaactcaccatttcccattctcgccctcccccagccctacttcctagcaaagccattgggacttagagcaaacccttagagtgacagatggcaggaacgctcatctggatcagcacaaaatgagactttggaaaataaacacagcatacttctgcaattctgctgtgggtttcctaggagcaccctccaatggaacaggagaggtggggctcatacccaggcctccgaggtgtgtccaggccaggctctgccaggctgacctcactcatctcctggtgtcccagaaagggtgcagtgagcggcagcgagtgcagacccagccctgtcatttgctactcgcgtgtccttggccactcgcttgacctccctggggcttagtttcgtaatctgtgaaacagtggggagcatcgctgtccctgagcacattgcaaacactgaatgcacacagcagcgggctcagctcacaggtctttgtcgccctcccctgctccatggatgatggggtctgctccatctcttcaccctaatccaaacaaagatgttcttcctaattcttgtttccttggagaactgaggtcttcagcgtgggttccagttgcatgctgtattcccaggctgacaccttctgcccactgcagcctgttccctgaccctctgtaactttgtttaattctcttgacctgatgtcaacataaaagaagactggggaatgaagcgagaagtgacaggcccagcttgacctcttgaaggtcttccattgtgtgaggcttgcaggggagtcttggctttggaagcccaaggacctatctatcttgaatcttaattctgttatctcattgggcacctatacttcagccccaaaggctgttcaatggctgtcatgatatagcacaggagacaaagctggctttatcagacttgctcagtaagtgggtggctgtctttttatcgtgttcctcctggctacacacacacctcccctggttatctctggtactttatgtgttctttactccttttttttttttttttttttttttttttagacagggtctccctttgttgcccatgctggagtgtagtagtgtgatctcggctcactgcaactgtgacctcctgggctcaagtgatcctcctacctcagcctccctagtagttgggactataggcgtgagccaccatgcctggctaattttattttttgtagaaaggaggtctcattatgttgcagatgctggtctcaaactcaaagttacaggtgtgagccatcacacctagcctatgtttgttacttaatggaatggatcattaagatgaatggcactgctgtgtctccacctcctcctccatgggcataggcgatgaaccaggaaaatatagggggaggagtgtatcattttatgaaaagatggtggggagggggcaggcccctgacattctctcttgagcctctgttcccatgatttgcctttcttgctgccatgggccttgactttatgctgatgagccatagtcagcttcctggacagctgttccagagggcaccgtaactgctctggccatgcttggaccccacttgctagactgagggagggtcaccaagcccaccaactgacttagatcctgggtatgcggtgatcctcttagagcctagaacggtcggcatctgcccagggcctgctgggaaggaggggattaccaggggcagcggggagacagtcacagctggcctccagagcccctccggatcatccagagagttgacttaagccagtggggctggccctgggagcttcacactaatcatctctggagcggttgtccataacaactgacatggagggaaatgctgcagcttgcaaaacacattcaggtctgtaccatggttttagtcttgggagcatcttaatggagcaggaggccttgtcattgacctcagcttacaactgatggcagggattgtcagagaaggctgataacttggccaagggcacgtggtggttatatcattaggataagtattgctcaaaaaacagtgctgtgccaaggaaatgtttgctattctcaccaacctagaaagctaacaccccagctatgaatgtcacccagcccagctggagttagtccttacagcttcctactgtcacctgagcatgcggctttggtcctcagattggtaggatagccaccgaacccccaagcatctcatccatgttccaagtaggatgcaggcaggagggtgaaaggacaagaatcaaaaggtcaagtttgaccctttttaaaaaactctccttgaagctacaggaattttctgctggcatttcattggccagaactgaacctcctgaccatctttggttacaagggaggtgagtaaggaaggggaccactttatcaggcactttgctgcttagtacatcagttggaattctatcctcaaaaagaagggaacaacagatgtttgggatgccaaccaacagagtctgccatagttttaaagctcccaagccagggttgacagccaaagagatgaaatctttaaggcatgcttggtgttaggtcctgtttccccacttgacagcttccaggcggtgtagaccatagtggtacgtgccatggttgctacttgccagcatataggcagtgtagactgtaaatctctaagtgtaccctccgggccagactctgtcaattggagagccagcctttccctctgggaattggcggcctggctggggaggcagctgttacacatatatttgtaattgtggtcgtgctgcaaagaagagaacagggtttgcatggcatgtgtatggtgggtagcaggaaggaggaggtgacgtctcatgtctgtgctgaggtgtttccagtgttggcacacttcctcacaaagacacacatgcgtgcagtttgggggcaggtgcctgttttaggaggatgggagcagcagatattatttctcgattctgtttggtagtggaacagcctgtgctgcatggatggccagtccttggagacgctggggaggtacgagtgttttgcagtcaaataagtgtgggaaatctgacttgctgcatcccctttagggagtcacagtgcacgttgcagagaaaggtttccttcccctcttctgcccggcacagaatgtgaaacaggatgttaaagagaacaggctttggatgcagacattcgaatccaagcttggttcagatcctgccccattattccagctgtgtggccttggatgaagtccttaatctctctcagcctcagctttctcatctctgcaatggttgttccgtgtatttaatgagaaaacacgtgtgagaaactcaaagcaggcatggggtaagatgcagtggctgtttattactgcccccatccctgccatcacctctagacttgaaagagcagctttctagactcttccagagcaggtgagaggaaagtgtgtgcagccaggtttttgtcttttcatcctcttgtctggatcaggccctgtgagcagggtcttctgtggcctggtcctgaactgtggaagagctgggtgtggggctctggatggtggaggagttgtgtttgtgttgccagccttgtcccagccagaagttggggggtccctcatgagcttcgagacaggcaatttgctctctcaggcaagaggacgaacagtgcaccttgcagttctgatgttctgggttccttgtgctttctctttgggaaaacatagaagacacgggatgggttcctctctccagaacactgagtgattgatccccgcagggacagaaggacagaacattcctttgggactgaataggacaaaggcctgtgtttgtgagtgttgtaattctcccattcaatctcagacagtcttcttgactggcttagaaccgcgtgcgtgcacgtgtgtttgttggtgggtgtgtttgttgtgtgtgtgtgtgtgtgtgtgtgtgacttaggggatgggacttgggtacagggaagatgacaacacttgcttttttcctcctcctcctgtgtgtgctggggggccaggaactgagtggaggaccgatgggggccagcagaccctggcacaaaggagcaagggcccagcggagagagttcgaatcctagttctaccaccacaaacctatgaccttgggagagtcccttcaacttctttacctataaaatgggattgatgggcctcccggtggcatggaggtctgataccctgccttactcttcgtaggcgcttagcaaatgttctccctcacctctgctcacctatgcctgggaagcagccctgcccctgtgtgaccttcaccacttcacttccatgttctcagacggggtctttgtccttcccaccaaggctagcaatgtcgaaagcctcttttttgagtcctgctcaggctgaggtttggggcagtgatgaggcagcagccagggtcctgacactcatgagctggggtgaagtgttagtgctctgtgaggctctcaccaaccctgggggtcttatcaggagggagctgagcatctcatggccaatccaagagcagagtggggaagatcccaacatggatcgatgcccttaggagagaaagttcctttctagggtgtaatgctcaccatcatctgtcgggatcagatctcttatccagcagataccgggtgcccactgagagcaggcagctatgcagaggcctgtggacagaaagtgagtgagacctaggcagcctttccttcttggactgaggaatagatcctccagtttagttctggttccatggctgtataattttaagaccttcaaagagatgagtcaaaaatctgctacccactcgcaactccgggggctgccagggacattcttgatgccagctggggtggcgtgtcccatacctgctgccacattagtaccctctgctgcctgcaccgggagtccccatcctgcctggtgctgtgctctgggctccgtgcaggtgactcctctcctgctatggagtctggggtgcaggcggccctcccagctcaggggtgaggacctggaggctcggaggttggggagtggtaggacttggatttgaactccgatgtccgtggcggtggggacaccgcctgccctggcctgtcttttagagggagccatgtgggtcagctggggagacaatgaagaatgtgcccccacaaacaaatggacctttgttcccacagtggcttcagggctgggctgggcccagcagatgatctccggccccctggaagctgggccactgctccctcatctatggatttttccagtgcctgttatgggcaggaaagaagtgttgggccctgaggggcagagaggggagaagggagatggggctgagctctgtgtgccaggggacttaacggtgttgggggctaatgcaggtgccaggatgaccccgtgctgggcgggcccgggtgctcccagggggctgggcctggccctgtacagtgcctctttatgtgtcaccaccctcacctggtaaccactgctgcgtccctgtgccattcaggaacagggaacttttaggtaaccttgaggagggcggaaacccagggcaggcgagtgaagtggcaattgagaaagagtcacgaccaccctctgcaggagtttagatgaacatggcaggtgagagattggtccatgagtgagctggggtgcttgtctcctttctgcagaagcacgatggtggcctggggctggctggcttcggggttctccaagtgagtgtcgggaacccctgcactcctccgctggggagggggaggtggtgagttcttgttggaaactcagtacggagctttcatacgctgcgggggaacctgggaattggatgccatttttctttatttttgaacttgttcctcaggttgagaatcgttggtcttaagggattcaggaggctttcctggtcccattcccagcaaccccccagtgggttaaatcctctttctcctttctcagaggacccagaggaactgcagccccccggggccatttccactgcccccactagcttgtgagttgtcacccactcgtccctgcggggacaaaggggacctggcatacaataggtgcctaatgaatgtttctcagatgaaattgaactgccttaagtatcaggggtaagaagtagcagaggtggaatccgatcaccagcgggtgtggatggcgtgggggtggctgcctcgtaccacttcacggggggtcactcacagatggagcagcctacattctctgggccttcagcacctctaggaggtaggaagggccaggctgttcctgttttaaagattcaagctggggaggaggtgacttgcccccacagggtgcctaagtggtgatctgtcccatcccttcttctcaagcgtgagtttgtgaacgctgaccttcctctctgctgccacacggcagtgatctgtatgggtcgcatttctgccagcttctagaagcaggttcaacagcatttagagtgttctgtgttccacttcactgcctcatttaatctttggaaaatcaatgcagcgtgctgagctgaggtggcctcgtgaggcctgagtgtgcgccgcttgcgggcgggtcaagtgctgagaagcctggggccccgcggaggctgattgtctgggggacctgcctctgtgctgcctgcccgtgtgactctgggatactgacttcacttcctcagccagctgggtcacatggctctggcagggctcctgtgagggtgaggacatggagggacatggttcagcactgccttgacacctggcaggtctcagcagcctgatggccttgcctcctgctccccaactgccctgtgggagcagagcccagagtggggcacttcaaaggggaggtcactgctctcagatgtggaaattgctcaagggagatgagtgactggggtcctcgggaacttctggttgaccttgaggagggcggaagcccagggtaggcatggggtgaagggtgagtggaagtgacaattgagaaagagtcacgaccaccctctgcaggagtttagatgaacatggcaggtgacagattggtccatgagtgagctggggtgcttggaaccaaggcagggtgccttttttttttgttttccagaggaagaaaggtgagcaggtcttcagctgttaggaaggtttggtgcggagaggtgcagggatgactgggagtaagctggctgggggtcactggccgagctggagagttggccttgacccagagaaccatctggctcaacaagaaggaagggcaggagggaggatgggcatggtatcattcagaatcttttggtcaactcaacatggcttacatgggattggaagttggtgggccgtgtaactgaaaatcccaggtggtggatgccatccccaaaccgtctttcactcttttccatccctgggctggccatactttcaggcaggcccttgcctcacggtgacaatgtggctgctacagatccagccctcccaaccttgctccatcaagtccgatccagttccccaattactagaaataagtgcagctggctttagttggcctgagccaacccatgtgttctttcctgatccagtccttgcaactgggaggtggagtgcatgaattggccttgacttgtgaaacgtggggaggggggtcactgtcaacagaacacttaggactgagggtgagggttgggtgggttcctgaaggaaactgagggctgttcttggaagtggggagtgaattctgtgtagccccaagccagcagatgttagtcacaggtacagtaacctgtggggccagtggggcctgagggcaaggaagcaaggaagcgcaggcttgatggcctgttttccagatggagcaaacagtccggggcagagatggtggcgggcaagccctttccccagcatttggtgcatttaacagcgcagtctgagccaggcctctgtcccctgcctcctgggagtcccctcctagccctggtccttggagtggcttctggccagagagagctgctgcccgaagccggggctcttatggccagatgagaagagagcttcctcaaaacacagttggaaacaggctggctgtcttcagccacgcggatgccatgaaccccacatgaccagcccactgtctgctgtgtctcctcaggagcaggacatcgagactttacatggctctgttcacgtcacgctgtgtgggactcccaagggaaaccggcctgtcatcctcacctaccatgacatcggcatgaaccgtaagttctgaggagctctgattccctgtcagccggttcccaagagagtggcggaaaaaggcagccgagaagggctgatggccgggagctggtggtttctttttgcctgggacttcctggggctgttctgggaagaactcttgccacagcctggaaaagccagaaatgcgctgcatgtgggcacggagttgtctgtgtgcccggaggcgctgggaacacaggaagctgtttgctatctgtggcagtgacttctatattaatgcacgcatatggttttcagtcttttcacagaattgtgcaacgatcagcacaattttggaacattttcatccttccaaaaaatcctgtaccttttatctgtcaccccaccctcagatgactgacccttcattgactttccttttctgtgaatttgcctgttctggaattttgtatacattgaatcaaataatatgtgatttttttttggtaactggcttctttcttagtgctttcaaggtttatccaggccatgcattaatatttgtatttcctttattcctttattgaataataatattccattgtatggatttaccacactttattcgttcttttttctttttctttctttctttttttttttttttctgagacagaatctcgctctgttgcccaggctggagtgcagtggtgcgatcgtggctcactgcaatctccacctactgggttcaagcaattcttttgcctcagcctcccaagtacctgggattacgggcacccaccaccacgcctgactaatttttgtatttttagtagagacggggtttcactgtgttggccaggctgacctcgaactcctgacctcaggtgatccacccacctccacctcccaaagtgctgggattacaggcatgagccattgggcccggccatctattcttcagttgatgggcatttggggcattttcactttttggctgtgtgagtaactctgctacgaatgtttagactgtgaattccaagattaccaggagggttttcttaggtgggttccccatttttcatagatgagaatggaatggaagctactgaatgttgaaatttcatggaatagaggtgaattcttctgtgaggaatcagaagacacaggtttcactggtcccgtaatttttatgaacttgagtattgcaagcttgcttgatttttgacgatggactgcctgattttcatttgtttctataaagcttattaataccttattaataccttgaggctggggatggtgtcactgaaatccactgaaaacactttttcacttcattctcaccttcttttatctcacttcttcccctgtctgtttcccttatatccattttgtaccaggtccatgctaggtattttgatttacactatctcattttattgactctgacaaggaactggaattgcatatggcagcgtctctccccattcggagaggctcattgttggtttataataggcttaccactgtaacaaaagatgccaagccctctgtggcttaacacagtatatgttttatttctcgctcatgtaacagtttagtgggtgtttagtgggacatgttctatttggcaattcaaggacccaggctccttctagcttgtgggtttgccatcccctggggctgcagagccttctgctggaaactgtgcttctggcaggtagatgagagaagagagaaacttagaggatcttagagaatctgggtggcaggtatggtgaggaaatggtgacggtcacaggctatcggccagaaacagatcacatggctgcctctcattgcaagggagcttgggatataccgtctagctgagtgcccaggaggaaaagggacaggaggtagggtgagcagcccgacttccttaggcttcagcagtgaggagactcatccaggccacatgaaaggaggaggcacgcctcacctcccatgctcctcctcgtttgaaaattatgtgtgtcctggaccagtaccccagatgggagggtatagtggacccagatggaaagagaggatcaggagggcaaagccatctcatgccagggccatcctgaccctggctgactggaggagctacaggagccagcctgggaaccccttccagcaccaactgcaagactcatctgccagctaccactcccttgccccatgaaacttactcttgctttttatcagcagaggaaagtgggcatggggacaaaaccaaaaaacaaaaaacgccaacatctgtgttcttctaagttcacttcctacttctgaataggaatgaaacaaaatgaatgtgctttgccaccgagacacctaatttttttctcatcttacttttttctcttctctccctcactgctgttcttcagacaaaacctgctacaaccccctcttcaactacgaggacatgcaggagatcacccagcactttgccgtctgccacgtggacgcccctggccagcaggacggcgcagcctccttccccgcagggtgagaggcctcttgccctatgagctctacagggtggaaactgggtgtcggggaggggttcaggtgctttgctcttttaaatactttttaactgtggtaaaatataaaacgtatcatcttaagcactttttaaattgtgggaaaagatacataacataaaagttagcactttcactatttttaagtatatagttcagtggcattaaggacatgcagacattgttgtgcagccgtcaccaccatccatctccaggactttttcatcttcccaaactgaaacaacatacttatcagatactatctccccattcccccagccttcctgcaaggctggcgttacgataggtgtgctcagcctggacaggacttcagtggaggaggacttgacaccaccaaatagtgtgaagaaaaacctagaagtctggggagaaacagagagggagagaagtaacattgatggagcccttcctgtgggctaggcttcatcatttgtgtctaacactgggcttaatccttacagctagctctgtgtggctgctgttgttagctccattttccagacaaacatattgaggcatggaggcattaactaccttgctgaaggttgcacagctgaggccgggcatggtggttcatgcctgtaatctcagcactttgggaggccaaggtgggcggaccaccgaggttgggagtttgagaccagcctggccaacatggtgaaaccctgtctccggccaacgtgatgaaaccctgtctccactaaaaatacaaaaatgagctgggcgtggtggcgggtggctataatccctgctactcgggaggcttaggccagataatcccttgaacctgggaggcagaggttacagtgagccaagatcgcaccactgcactccagcctgggtgacagagcaagactctgtctccaaaaaagaaaaaaaggttgcacagctgatgactggggagttggctttgatcctatctactgagacgtgtatcctctttggaacatcaggctgccttagttgagagtatttgcactgcctggcccttgtcagctcgtgatctgtatgggcatggcctttcaatttccccttgtgcaattatggtcaagcttgttggatcccccaatcagcatcatgtgggggtggcagacctcagagataacccctcttgtccctgcacctgacctgtgtttaaactagggcaggagcaggttcttgggcttaaagtcttccagaaggggccttcttggcatttataaatagatatccttttttattagtgttcagaattatccttaataattaacctttatcagagaggaagggaagggacagccaaccgtatggggccaggaccaaaaattaaaagtgtattaaaacagtgggacgtggttaattgttaaccagcagataaagccagaggtgtgtccgtaaatctttggttggaccagttgtgtgaaagacttgggggaaagcagagactcttagttccccctggtgaagttttacaaatattctgaggcctgagccccacccccaggaatttttattccgttggtctgggtattacagcgcattttccccctagtttactatgtggttttcgtgtgcatctggtgggacccactgtcagagtgggacctgacttgtttcttcctcctggagtagggcagaggagagtgtggggcttgggaggggtgagggagcatctcccaggccctttaagggtgagccccctgtattctgaagccgagacagcagagcagggtaggggatccctggctgggctcctcctggccccggtgtccaccacctacacaggagggaccttggaagtagaattctgctgcttcctcgcctcacaccagccctggggaacagggaagaaacagagggccctgcaattaagtggcttctccagtgtcacaccttaggagctgctggctccaaattgagccatggccatttcagaggagcttcatgtctttgccgcacttctgccctgcggcttctcagctcagtggctctgttgatgtggagccacaccatacgggctctttctggctcttcccagggcgtccgcatacactgcttccctgcccacacgctttactcatcaggttcccatgaccccttcagcgtcacttcttccaagaagccctccctgatcatctgagcacggcaggtctctgtttcgataggctttgttatgagtaacaccccctgtttctgttgactcgagggctggctcctgtcctggtttgcatctgctttgctcacagacccctgccattgcctcaccaagagcccggcatgtgtgaggatcaatcactgctttgcggatggaactcattcatgcctgttttaattccttctccctgacattggaattgtgaaatgccttctagtcagtttctgcaacaccctagacccaaaaccagacaaacacagtgaggacatgtttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtgtgctgcaggggtcttggaaggaggatgcgaagggactagacttgggggtgggggggtctgggtgcatggggcaggctgctgcatggtccccacccttcaagcgtgtccctgtttggattacccgtttctgtccgggcgctcactaatggcttctctgtgtcatccccaggtacatgtacccctccatggatcagctggctgaaatgcttcctggagtccttcaacagtttgggtaagagcgaaggatcagctccttctctgtctgcagagaagcctggtttctagcatcttcctgccccttggctttgatctggactgaccactaaaattaaggttgcaatttagagatgaggcaagaaattagctcgtcactctgtgaacactgttcttcacacagtctctgagctctagtctgtctcctctaacttcagttttcctcttgcgtgaatgttatattgcatgatggcagctgccccacccatttgctcttgcctcctgttcttccattcccttctctttcccatggaatgttctggaatggagttgcctgagtccttagcttttctctccacaccctcatttttccagtgttcctctctgtcttgagctcttcaaagaatgataacttcatggttcttgctcaatttgttttcattccaagttttagaatccaaaataaagcttaagagtgggaagaaatgatgccgtaacgggccttcccgtaaatgtcagacggtctctcagagcctgggtggcggccaggagggaagtgaggagaaggggcgcggctctccaaggtcgaggtctctgtccagtcctaaagcatggtgacctcagagctgtgcaggcagttacggcagcatgctcccgcattgcctagccaggcggtcaccctcaggaagttctaagtgggtccttggaggctcccgtcactctgtccttgtgtgacatgcatttgtatttttgcttccaggctgaaaagcattattggcatgggaacaggagcaggcgcctacatcctaactcgatttgctgtgagtgctttggcattttttgaaaatcgcattttaaataacattttaagatgaaggaagacattggaaaagcatcaaaaacccaaaagggaaaaagaaatgacccgtattctccacagttgtgtgtgtgtgtgtgtgtggtgcatgggtactcgtatatatatatactcacagccttttctcttcctccactcaaggatgatactggacacattcctttgtcatgggctttgtccgcttagccatctagtgaggacgctcctcactcactgagtactctgctatgacactgctttgtaacagctgtacaggtttttgtagtcagggcactcctgggtcataactgattctaaactagaatcagacacgggaagttttcatgacagttgtcattgttatttctctgggctcaggtcaagagccactgttcctttgtatcctcaccgagcaattgtgtaagaatgcaacaatactcattttgtacatccattggtattttgactacctattatttgctgggctttgctggaggttgggaatactgacatgattctacaacatccatcttacaaaaaaaagaaaggaatgctgacatgaatacaaaatggtctggccatataggctctcagcaaattaaaaatggtctcaactgtaccccaggtgtacatatctatatctgtatgtatctgcatcacataatgacattttggtcaatgacagactgcacatttgacagtggttccataagattataatggttcatttttactgtaccatttttatgtttagatttgcttagatacatcaatacttagcattgtgttgcaattccctgcagtattgggtagcgtcatatgctgtacaggtttgtacagcaaacctaggagcaaagggctgttctatacagccttggtgagttgtagactatactgtctaggtgtgtgtaagtatactctgagatcttcacacaatgacaaaatctcctaatgatgaattttctcagaaagtatccctgttattcagcgatgcataactctgtctctctctctgtgtgtgtgtgtgtgtgtgtgtgtgtgtgtgtgtatgcatgtgtttatcctggaagtaagtaatacagttgttactgccacaactagagagcatttgtgctgtgcgccttgtttgattgatgaggtcgatggtgtgttacacccatttgatagctggagaagctgagcctccgtgggttgaagtgacttgcccaaggcaggcctgcaaagcagcgggcttcctacttctcctgcacttcctctttctccttcccactctctctaggacccgataccgtgtctgctgtgctggaacctcagttttgcatggggtggggccggggagcagcagcctgctctgctgcccacactgcctttttctgggtacttctctcaagctttggtttgccttggaaagttcctagtgtttcagattgctgggatgtctgtctcactttgtgtcttgaattgcagctaaacaaccctgagatggtggagggccttgtccttatcaacgtgaacccttgtgcggaaggctggatggactgggccgcctccaaggtgaggtgggggcctgtcaggccggcgggatccctgcaagaagagggacaggtgcacacagcctctgcctgggggatccctggagctacgagctctctctttacccactcctccactaccctctactgcccactccagttccctctgctttacttagaacagtacacatgacctcagccgtttgccattcagaagacttaaataccaccaagctgtctaagccagggaaagcactgggacacaggtccctgaggcagcttggagaagcattgcttggattaatgagtattagctgggtacataacttgtgccaggctttggtcaagatgctgagcatcttgaagaacaagacttcttgagatgaacaagacaaaagcctctaggaatgaatcttaggaatccattcacatattattaaagaaaaataaatatgtatttagtacggactgtgccacagaattttacgataataattagctaacgtagattgagagtttaccatgtgctagtttcattctacgttgctgtgtgtgcatgatctcagttaatcttcatagtaactctaggaggtgagaatttttatcaccgtttcagaggtaaggactcggtgtggctaaggggattgtccagggtcacataaagctaggcagtagaacggggactggatgcagcttgctttgactttgtggttcgtggacctgaccacccgtgcccctggggctcctgtccagggtgggagacaggcaggcctggcaagcagggtaggctgcctggaggagaagggacctgtgctgtcttgggaagctctgtcctggctggtgtcctaaggttccttgtttatcttttaaaaattatcattgtggtgtttttgtttttgtttttttccctgtaaaggcctcagtgttggccaaggagagggggaggtcattccagttgaaataggacagagtctttcaagctgaggtgatcgcagcttctcattctgcaagtgcatttttgcccaattttgggtggctgccagggaccgatggtttgaaggggccctgcctcttgccccatcccctgccctgtaccagccactgtgattttgcatttgttctttgaacattcctccagaatgcaggagcccttccgtccagcctgtatgacgttctggagtggaacacactccctgttttttatttgattttccagcaaaggaagtgacattccagtcaacccgctgggcttcatgatagctgtcctgagtgagactcgaaggtctggggatgtcgaccactggctaatgtgaagcctgaggattgtctttaatagctgtactattcccttcagtacagctttaatagctgtactattcccttctttttcaactccagcctttcgattaccaggcattggtattagatactgtgatgtgtgcagttacttcttgcagtccttcccttgaccttgtggccttgaagttcctggcactcccagttccagattagaagtctgagacccagaggtatgcagactgcccagtgccacacagctaggctgtggcaggcaagggccagccaaagacccttaggtctagagcttctctcctactcatttttgcctaatgcttaggtcagcacacatttatggagcttctgctgtatactaggacttatagagctcctgctgcaaacctagtcactggggagaggtaggaaaagaagattgtcagtgtctttggtaatatcagtatacttagaaaggggaaactggcttggagatgagagaggagggatagttgggagccaagcatatcttggggtatagactggggagctcagtgtgtttttagaagaggtgaatggatggccctctttgctgaggacttggtgaatgtttggagcagggtaagctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggtgagttgcgtggtctggcaaatctgttgttcctgctgagcaaggcattgtgtggtgctcagcacagggccccatgtgggggtggagagaacaagacacaatcaactgggggccaccgagctggtgctcatgagataatgtgacattattcattcataagcaacaagtcattcattctctctcttttttatgtgtcttttaaaaacagctgattgaagtacaattaactgcacatatttaaagtgtacaattgacatgcatatacatttgtaaaaccatccctgtaatcaggagaataacgtctccatcactccaagagtttccttgtgccccttgatagtcctcctctccctcctcctcaggcaacttctgatcagcattggcctctatagattgctttgcaattcctagaattttatataaatggcattatatagtaggtactcttttttttttttttttggtctggcttctttccctcagcataaccattttgagatttgtccatgttaatgagtggatcaatagtttattcctagtcggggtgcagtgctcattcctataatcccagcactttgggaggccatggcaggaggattgcttgagcccaggagttcaagaccagcctgggcaacatagtgacaccttgtctctacagaaaaattaaaaattggccaggcatggtggttctgcatgcctatagtcctagctacttgggaggctgaggcaggaggattgcttgagcccaggagtttgaggctacagtgagcagtgagctgggatagcccactgtattccgcctaggtgacagagagaccctgtctcttaaaaaaaagtttattcctttttagtgctgagaagtattccattttatgtatgtgcaacagtttgtttttccattcacctgttgataagacctttgagttgttcccagttctgggctgttataaatctggtcagtagcaaacatgtccgtggagttagctgtgtgctgggctgggctcagtcctaagagcttcacaagtgttaactataggaataggattccacccaggtgctctgtgacctgtgtgataaattctgttctcattcccagtttatggaagaggaaacagaccagagaggttgagtgacttgcatagggtctcaaccagggagaggtggggccggtattagaacctatgaatctggcttcattctggtcaccacagcaggatggcggctgcctgtgctgctgcctggctctgagatgagctgctcttctgcagagttaccccactaaaggggattgagccaagcccctcacagcatgctagaagtgagcagtcatcttatcagcccagcctgcctggccccagacactggttttgtgtctctagctggggccagctaccctcgggaagggtatgccatgggcttggttgcaagcccagggtctggaaaaccccttggttgcctgaaattgcagtgacctgctttgcttacataccactgtctgcttctgagctaacatgtgtgaccatctgacactcccatgagtcctggggacacagcctccactctggagctggcgagtacaccaggggaacagacgccccactctggagttgacgagtgtaccaggggaatagaggccccactctggagttgacgagtgtacgagggcaatagaggccccactctggagttggcgagtgtacgaggggaatagagtccccactctggagttggcgagtgtacgaggggaatagagcctccactctggagctggtgagtgtacgagggaaacagaggccccactctggagctggcgagtgtacgaggggaatagaggccccactctggagttggcaagtgtaccaggggaacagaggccccactctggagttggcgagtgtacgagggaaacagaggccccactccggagttggcgagtgtacgagggaaacagaggccccactccggagttggcgagtgtaccaggggaacagagaccccactctggagttggcgagtgtaccaggggaacagaggctccactctggagttggcgagtacaactgctaggtttgcctgttgtgttggtttcctgtggcttctgtaacaaattaccacaaacaggatggcttagaacagcgaaagtgggatgagcagggtggctcacacctataatcccagcactttgggaggcttaggcgagtggatcacctgaggtcaggagttcgagacgagcctggccaacatggtgaaaccccgtctctactgaaaatacaaaattaaccggatgtggtggcacgcgcctgtaatcccagctactcgggaggctgagacaggagaatcacttgaacctgggaggcagaggctgcagtgagccgagatcgcgccatgcactgcagcctgggtgagacagagggagactctgtctcaaaaacagagaaaaaggaaaacaaaagtgtattctctcacagctctgagtctagaactccgatgtcaagcgctggcagggccgcccctccgccacaggctccaggggaaattcgtccttgcttcttactgctccaggtcgctgtcggcattccttggctagtggctgctcacaccactctctgcctctgtcttcacatggtcttctcctctgtgtctgttttatttctccctctccttcctcttttaaggatactttccattggatttcatcccggctcatgtaatccaggattatctcatctcaagatccttaattaattacacctgcaaaaaccctttttcccagcaagtttgcattcccaagttcaagagatttgacatggacatatcttttgagggccacagtttagcccactagagtcctctttccccttttacgattcattccacagcgtgtgacacattttccctgtcctgagtgtgtaatctgaaactgataggaattgggaaaaattcacagccactgtctctgtttcactggaggagggatgtcagacatagcgttgagcatctgatctgattataccccaagttatttggagactggttggtccggccatggtgtctgagggtacccccagatcgctatagttggttttgatctgaaatcccagcgtgattcctgactattttttccagagtttgctcttagtagccagttgacctccttgctgcctaaatgatcctggactgtttgatgcagctcaagcttgacaccggctttctttgacccccaactccaacttctcatctggttgccactggtcatatcagacccttgtgtgaaacctacagtgtctgccctcgtacaaatgagaaacagagcaaacaagttgtttgtcgcaaataacattcaaaaagcacccagagacggggaggctgaggccgacttccccaaggctctggttggccgtggtgggagttgcaattgcccttcttttcagtaacttcctgtggcatgagttgattttgcttttcaagcatgaaaaacttcttttcagctcttcccattggaaaacaattactaacatttgcctccaatttttactgttagtagaggtgagaacacaacctccattaagtcctacaacctagtgaagtaggcaacattctctctcttcccttttttttttttttttttttaagagatctgaggctcagagaggttgaaagatttgcctacgaaagggacagtgatgaagctaagctctagatccaggatgtctgacttcaaattgaaactcccaaagtaatgagtttggaagggtggggtgtggcctttccaggatgggggtcttttctgctcccagcggatagtgaaacccctgtctgcacctggttgggcgtgttgctttcccaaaggttttttttttaggtccgtcgctgtcttgtggattaggcattattatctttactttgtctccaaataacctggagaatggagagagtagtgaccagctcagggccacagtgcgatgaggaccatcttctcacctctctaaatgcaggaagaaatgcagagtaacgtggaagtggtccacacctaccgccagcacattgtgaatgacatgaaccccggcaacctgcacctgttcatcaatgcctacaacaggtattgggatgtagttcagccacatcattgctatttatgaggtgtcttctgtagatccgaaatgtgggacagatgagagggagagtataaaatgagcggaagaggcaggctctgagtttgagcaaatagattaataggacaggtgtccccaggaaggacacctggcctgtaagctggttcctggcattcagctcgccttgcagggatctgaacaaacactccagaccactgggggtgcagacgtgagagggacgcagtcgcacactcagagggttgagagtaaatatgtgtgcccgctgctgaccttcacgaaaggccaaatgtaagaagagctaagtgagagagcagcaaagcactcctggaggccggggataatccaggcaggcttctgggagtttgtcattccaaggataaggaggacctgaacatggcctttgcctaaggcgtggccctctcaaccagcactaggtgcttatctggagctcagctaggggaggagacagctcagggccattggtgtcagccagagactctgtaatcttccagggagctcgctcaacctgctgagctcgctctgccacgctcgcagaacaggagatagaaatgagcctcatagtgtttatctctgctcaaatgttaataaagtgacttcttgaaattaacatttgtaacagagcttagtatctgcctccttttacaatcctgccctcatctcagtggtaacatcctcactgtggatgtgactgaagaaaccgaaacctggcagtgcggttcacttagtaaacactttctgagaactggagcgagtcaggcattcggctgggcgctggagacacagaggaaaccagcacagcccgcagactccacactgttaacttgcccgtgtagatagcaccgtaattaactgacccctctccaaatcccactgtgaaggtcctggaattactgtcatttcctgttgaggaagcaaaggcgcaaagagatcctgtgttctccccaaggccacacagctagaaagtggcagagcatgatttggatcctgcttgtctaactccaggctgtgagctgggaaagagcttctcatgttgggagctgcaagatagcagagagggtgggtggctgcgtgcaggaaaggtggtcggcactgggctggacccacactgggcctcacacgagtgcagtgggaaaccaccacagggtttgagacagggaatggaaagatgaggcctgagttttaaagagatcatttgggtgctttatagaggactcagagttggtgaggctgggacttaaactaagaggctgcgagagcatttgggaggtggcccctctgtcaggtgggggctctgactagggggacagggaaggcggggaccctctatggtggagaatctgacttctactcctggaaaaaaaagccccacaaatatttgtgacaaaatgagggggctctgcttgaaatgcatgtgttgtgctgtccctctaaccaggtctgtggacaccaagagggtgtggagtcctgaaagccacagggcctctctcaagttggggatgtgggtagcttaccagaatggccactggcaggacctcctgggcttggctggatgggagtgggagatttctccaggggaggggtcctcatgctaatgatgcatttgtttcctgcagccggcgcgacctggagattgagcgaccaatgccgggaacccacacagtcaccctgcagtgagtggcttttctctcccccagcacttgcagtcggggctgcccactataaaggtggccttgctggcagggccttctttctgagtgtggcaggacattgtgtcagtgagacctggatatattccacccagagactgagcattacccagcctgacttggacttctccctgtgccggtggcatccgtttctagggtgtccccatgacctaggcctttgatcttggagaaggatggttgattgtacttgggacagcatttattaagcacctactacatcaataactgtgtgaggctttgctccatgaagcctagggatggatagcacaggacccagccttaaagtgctccatacacctaggaggaaaagacagtcatggacagaactaactgggtttccaccagtaatgatggtgtctttttgtggctgagtgcaccgcgttgtgtgacacttgggaacctggcacgtcattgcctttgtccttcatgctgttcttgtttcggtcttgattgccagctaagtcctgcttaaccatccttgaggagaagatgctttaaaacaaaagcactgagtcacagaaattccctggctgaaattcatactaagttgtgaatgactagtaaccaatgttatcctaagatcaaaggagaatgaagtaaaagagcaaagggtgttggggaaaccaaaatgacattgtttgtagaatgcaggccccagcctggcaggcctgggagtgggacaatctttaaaggaaccttgtgctaattctctgctctatccctgaccccaggtgccctgctctgttggtggttggggacagctcgcctgcagtggatgccgtggtatgtagaaatcacagctgatttctgtgtttaattcaacaggcaaagtctggttgactttgttgaagtggccctgcctgcccctcctctcctctgccccatcagggcaggtgatgttttttgaaatgccatattggcctttgggcagagggcccagccactcagtctctttccctggtggctgccagccctggttgcttggcagtgtctcctctcccaggtcccctcacccgccagtctgtgtcccatcggcttgtttatatgggcatgtttgccacttggcttcctggccaagagactcacctcttatttgggaagcagctggatctttccaaactgactggtgcctgatgagctggcaggggagagaggcactgggaggcagggcttagcaaagcttcctgactcctttcaccccttaactcccacctgcaactttgtggcagcaaagagaggaatctgcctttcaaacaaccccacagctggggagatggaagacttaggggctatggatcagagtcctgcagtactgccatgctttgtgcagtgatctgcagagtgacatttgcaaatgttcatgtagtaaatacctggcatgccttagtgaaccatgagtttcttacgggctgactgactggagataatcatgggatacatcaatagagatacactgttcaaatcaagggaggtgatagttttactttaagcattttgaacatcctgggttacatatgggtattctgcccaattccagatgcccctttcaagaggttcactgacaaaatgaagagagaaaccagtgtgattttacatgaagaatagttgttagatctgggaatattaaacctgtagaatctctggcagctgctggttaaacaaggatatttatttagcaggtatttctacagtactgtttacatttcggctaatcttcataataaccttttgaaaaaagatattagctccattttattgatgaggaaactgaggcccaaagaagttaaatcacttatccaagttgtcacagctggtaatggcaaggctgggatttcaagccacatctgctgaatcccaataactccacatactttcttctttgccagcagaaatactggagtttctggtgacggtggcagagtggcggagaagggggagatgttttggctttggcttcacgtagaaaattaacagatttcctccctcttgtgcaggtggagtgcaactcaaaattggacccaacaaagaccactctcctcaaggtacagggaaaacagtgggggttcgtgtttgttatttcttagaaactctcagacgttttctgcaacattgagttaggcttgaaaaaggcaaggcacacgatcagaaactatagaattaatgatttaatctatctgtttatgaacatatattgggtgctgactggtgatctgaggctgcaaagatgagggatccttctctgggactgcaggaatcaataggctgctggtctgggggctttggggatagagggaccagggatggcttggcaagggccctccataggctggggccaggacattcctccaagaggggctctctgcttgtcacaataagaagagacgtgtcccacagccggggaaggtcaggactttgtccagcaagttcatctgagcacatggtgagccagctcactcgcagctggatttgagtgtctgtagcaacctccgccagtcctttgccagttatgactgattgcacaatgcaaaccactggctgtttgtggcggcctcgtccggagatgcagcccaagagtgggaacctttcagaggggcctctcagccggggtgcacccctgcaggggcagatgaccaggcgggacctgggtggagatgaggcggctccctcgcactgggggaaggacaaagaggtggcatctgtaggtcaccgtgccctcaacttcccccatagaagtagaatgcctttgaaaggcatgtagggggtgtccgatacttattgagtgggaggctgttttcctgtattgggctctttacatagattttctttcaagattccctcaaaaggaaattgcaagattagaagctgctgggcgtcaagcttgcataatgccgtactttgagggcggttgtcacaagtatcacaaaatgggtggcttaaagcaacagatatttattcccttttagttctggaagctaaaagtccgaaatcaaggtgtgggcagggccgtgctccctctgaaggtgctaggggagaatgctgcctgcctcttccagcttctggtggctgctggccacacttggttcaccttagctagtagacacatcactccagtctctgcctccatcctcactcagcactctcccgattgtatctctgcgtctatgtccaaatttccttcttcttttaataacatcagccgttagctttagggcccgctctaatccaatatgacctcatcttaacttgattttacctgcaaagaccctatttccaagtatagccacagtgataggtactggggttaggacttcagtatgtctattttggggacacaattcaaccacaacctacagcaaagggtaggtggcctgactgaggtggggtggccgatttgatggtagatccagaaacagaactcacttaggcctgattctggagacttccacagcgtcagtctaatgtgctgagtgccccgcctggaggaaaaattcgggcatcctgctccctgcgtgctggttgagctgagggctgccccaggtcagtgtcgctttgtggctagtgttgggggtccacacttgaggcgccctgggctgtaggatgcccacagcctcaccactcccatgaactcctccagccccgtttcaccccaggccaccctccccgcagcctccccctgctcccttgccgtcagcgctgcccatttccaggctggctgcacagtctcacagcctgcaatggcctcttgcggttcggtgatttcacagggactttgaacgtccaccatttaggaagggtactggtcagctgaatccggcctgaagacccaaattcaaccacttccttttgagggaaactttcaagggaatatatgaagagggtcttgtttatcaaaccctttcgggtcagagagatcctggcctggaaccttgcgagtccctcaagctcttcctggcccagtttctgcctgtaaaatgggacagctgtaccttccatggttcttggggaatggagtgaaattatctgtagggcctagcatagtgcctggcacgtagcaagctgcaagtgatggttgccacggagacaccagcagccttgcctggtggggctggattgttccctacccacggtccaccctgttcctcctttgtaaggcaggacaaggcagggcagggcagcgggcggatgggcatcctttcggaaaaaattcatagagcgcagagggccttggctgtggtgtttggcactaacgagcttccctctctcctagatggcggactgtggcggcctcccgcagatctcccaggtgagtgccatgttggcttttgcattatacagctgtcgcttccccctgggtggagtgcatgtgcctctgtgacacctgttccctcattaccttgctgtgacatcggatgacagtttgtggactgttgggaaaaggtgctatataggaggactctgattccctaggaaccaacccctgtggagtaggtgatactgcggttcacagaggttgggggatttgccaagtagacacaccttggtcatcatgggtcagaatctgggtatgtctgccccaaagaccacgggcttctgctggagtgaagggccgcaaggagctccagcccagagcagagggacatggaggagattaagccaaattgtgtgtgtgtgcatgcatgtttctgtgtgtgcatgtgtacacgtctgtgtgtgtgcatgtgtacacatgtctgtgtgcatgtgtaaatgtgtgtgcacatgtacaaataaacacattgatcaacgtaatgtgtttgctacgtaactgatcccttcaatttcccctcctataaagaatctcaccaacctaacaagtaaacttttaatttgttgtcttataattttatatcctgacagttttgtgttccatcttaaaatgaaatagagttttttgtcatcttttttatccaaaacctgccctgcctcctttcttcctcctttttttctttctctacttaaaatgagaacagatgtaaccctggtcataattaaaagaattttcagagcttcagaggagtgcaacgagcacaggcttcgaggacaccagcacaggggggagcaattcctgtgtgacactgtcgtcctcatgccgttgcaggttgggtgtatgtttacacagggttttcccatccttgattaaattaggtccttgcaatagtcctcagaggtgggaagagcaagcattttatcccagtgtcacagaagaggaaactgaggccaaaagttgagagagattgcccatgattactggagctaaaattgggcccaagtgttctcattcccaagcgtgtattcttggttctctccaccatctcgaacacaggcgtccctgttccctgcagccctgacctgcttctcttgtctctttcttccactgtcacacaaattccagagggcaatttgagcatagccgctcttttaaatgtcatttggctctttgtggaatcctggcaggagttagtggagagcagggaggggggtcagcccagcctctaccagtgccctctcactgcctcaggagaataggacccagggcactggatagaacagttgggattaactgaagaacagatacgccttgcacgtatgcccttgatatttgagcattcacctccaagtttacattaaatgaactgagagaactggtagaactggatgtggtctcagcattccatacgcatttcacttaaagtagcccagttagttgttaattaattggtttgtttacccatccaacgaaccatccaaccatcatccattcattcttcttcatatcctttcttccttttatttgtccttcttttgttcatatttctctttttttcttccttttgtccatcaattctttttttaatccatctttccttccttccttccttctcttcctttctttcttttttccttccttctttccatccatccttttctttccacccatccatctatccatcatcccttctttcagccagcctgctattgaggctgacagtgatttgcctcaagaacaagtgttttaggtttggagagccctgggttaatgtacaggacccaccacttacttgttgtgggaccctgagtggatttacctgtccaaatctgttcagctatgaaatgtatctaaggtagcactgacctcgtgaggggttgtcaggagtaaatgaatgaacgcagcaaagccccttgcattgggagtggctcatgatgccgatgcagttatgttccacttgctgggttagacatgtccctttgtggatggtaatctcctcagaaacacacagaaatagctgtgatactctgccctgtattacaggtgaggaaactggctcagacaggtcatgtaacttgtccaagttccacagctgtggggtgaatttcccatcattgtcccatactcttacttttgtgttttgtcctgtcaacacgtgatggcttttgtcttgagccaaactctcaaatgaaggtgaccacaggcacagccccccatggcctcgggtgatctggctccccagcaactgactgcattttctctccttgtctctcgcagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggagggcatgtggcagcctggaggatctagcctctcatttatcagtgaggctcatttttcctcctttgttgaatagaagttgtttcacaccagggattttggggggtttagatgaggactgtccctttaagcaccaagacaatgaccaacagtgaaacaataacatttttaaaaattttgatcacaagttttaagagaccactagctacagtgatgatgaagatggtgtcgatgatgatgaaagattactaacacattattttatctcactgaaccatcacagtactcctttgacatattcttagcccatcttatcagtgatgaagctgatgcttcggggttgtaagcagggagcagagggcggatctgtggaaattctttgaagactgtgaagctctgtggaagtggctaacaaagttgcttacattcaaggtggagcatgccatagtcaagtcatgagctttgggaagtggaggatacattggaagcatcattcaggaactcactcgttcttattttgcagttatagtttgttagacacatacagccttttttccagaagtgctgtcccaggactaggacagaccctggcgagttgtaactcggctgaacagcagccacactcagtgctgtgggcctgtcagccatggtccggccctgacatgactagtggctcttctgaccctactgcttggaactataattcgtgtgtcctcccttactaggaagttattgaacttctgatcccttttatcatttccttaaactgtttgcccatgtatagtaagagtatgcttggtaagctgactgcagtcctagcattggccttagccatgattagctctagcaaggcgaggctggcaggtttgatttccatgcctcaggctcaggcaggatccacatccccaggtgccctcttccaacagaagctatctgctagtggggctcctgcctttctagcctgctttccccgacggaagttgcaggcaaaggttgtcattggagacagccatggagacagccgcggggcagtcctgctttaccctgcacggtgtgaattgtggctcccatttgtcttggtcccgccagggtttggatttctgctttgagagtgtgttctggagagaaaggaagtgaatgctagacctcatctttctccccaaatcggcttctattaccagaaagctgaagcctcctgcaggtcttggggggaaaataacaggaagagctatggtctcaaaggcatcagccaaagagaaggaaaggaaccggtcactggccttctgcacaccacggggtgctggcttgatgaaccctttgcacacctggcatcagtgctcactgtacgcttctcatcctgctcagtagacatcccagatttgtgggtgagaagtaggggctcagagaaatatgtgagctgcggatgtggcattgaccccaattctttctgaattcaaaactagctctttaagacaattcagcaaggattaattctgtttgggagtgcctgacatcaaaagcccctccctgtgcctatcaaggagataacataagccctgcatgcttggtgtggatcaactgcccctgtttctgatgtctgactcagtgtggcctcctagccatgatgcttcagttgggtggagtactagtttcctaaagctgccgtaacaaatctccacaaactgggtggctgaaaacaatagaaatccattctctcaaagttcaggaggcctaaagtccaaaatcaaggtgtgggcagggccttgctccctccaacgctgctgtggaagaaccttccatgcctcttcctggcttctggtggccccagcaatccttggctttatgtggcttgtggctgcatcactccaatctcagcctctgtctttgcgtggacttctcccctgcatatccctgtgtgctgtttctataaggacatcacagtcattgggtttagggttccctctcaacccaggatgatttcatctcaagatccttaactaattacatatgcaaagaccctatttccaaataaggttcccttctgaagtttcaggtaggtgtgaatcttccgggacactgtcccacccggtacaggtgggcaggattgttcctcctcattccaccccatcagcacgtgctaccccatcagcatgtgccacttgcacgtgccatgtgcaagagcatttgaggtctcagagaagatcccaaagaatagacagcgcccttgttagcacctgggctgacaggcttctttgggagagatgacaacgaatagccatgccgggaacttgccgtgtggcccctctccctttccccacctgtgatgtgcagggccactgaccccaggtgtcctccctgctccagtgatcatggacagcatggggtcatgggcgtacacacaggtgctgataccaggggtcagtatttaacatacttgctttacagatgggaacagggaggctcagggggacactctcaaaattacacagcttttaacaggtggcagaattggggttcagacccagatctgggttcaagtcactcatggtgtgattgcggcagttccttcccgcatctgggccttgccatctctctctccgagtggacatggagaggacgggggcccagcagctggatggctgcagggatcaagtcttctctggggctggcacgtaaaagagcatgtggctggtggacgggcatgcctggctcctcacctggcagtctcctgccctctaaccggctgtctcttgttcccctagtgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagac

SEQ ID NO: 172 - DNA, 71470 bp, Homo sapiens
tgcgagcccagcgtcaagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgaggtatcctgagtgtgtgtatgcttgtatgagagactgagagagataaatacacatagagacataaagagacatgcagaaagacacagcagagaggggaggggggtcaagaagagagagaaggaatgaaacagaggcaagtagcaaacccatggaaagtaaagaaaggctgtttttctggggacatgtatgacccagctgggaatcgggagcacagggtcatttggggagcatctgtataacaggatctcatttcttgctgggtttttcatcaagctcagtactctagtcaaatacaagttaagccctgtcttgcagggctcttgatagaactctctgagaagcagtgcagaaggagaatgattcctgcagtaagaagctgggggcaaacagactcaggctcaagtctcagctctgccactgaccttagcctgatttatgtgacttttctgagcttgtttacccatctataaaatgggcacagtaagacctatgtgctgaggttgctctggagctattatttaattcatacatgtaaaatatataacatcatatatggtgcacacagtaggtgcttagtaaatactgagttcctccctatgcacctcttagcttcacagaactattactacctatcctgaggatagctcccttttttgattatctacagatacagccggtacagaatttgcagttagtggaaagaaaagagaaaatcagttttatttctcaggttaatctgaccttaatacattttatcaaatattaatgcaattaaagtcttctgataatgtgacacaaatccagatgttcttttgtaaggaaaagccactgtgaacttgtttggtaattgattttttaaaatgttgaatattatttttaaaagctttggcttctttaagaggttttggcaagaatgagatcaaactcctgatggaaaagatggccctggggaagccttgctatacagcccaaggtgtattcatctctgtgaggaatagtcttggtgtgccgggagatcaataccaggtggaagcagacagctgcacagagcaggtgaaacagggcccttatcaggggagaaatcaaagatggaggaaaccaaaccagcacacactaaaagcagtttctcactagcaccgagaaacaggccagtgggagcccagacttgagatgagggcgttaagaagggcatcagaacttcacactgatgaagattatagactgggagaagggagaagagaccactagatgtgaatcctccttatctttgtgacctcaggcaagttgcttaacctctctgtatcttctttccttcattcgtaaaaaggggtgatgatgataatggtagtaccaactcagagggttgccgtaggggctaagtgagaaactacaagtgaaatacttatcccagtgcatggcacaaacaaagtactctttaaatggtagttttcattaccaaggcagttaattctcactctccaacaaacatcctgggaaagacaggaacaggtggtatataataaccgggaactaagaaaagtccaattaagaatggttagaggcttagagacaatttatacttacatgaatttaaacaagattcacactaccatatgatgctaattataagaagaaactagatgttaatgtataagctataatactaccaatttatttttatcttttagaaatgcttgaatccatgagtcacaaacttaggctcaagttctggctccattgccttctaagtgcccttgaataaatggctaagggtaaggacttaaaacataaagggtcttgttttctagggctatacttaaccaaattctcagtttgttaatcttaaaaattggaatattaataataatgcctacatcatagaatttgggggaaatttattgtgttagtgcatatacagtgtcaggcgttttggaaatgtcaggttaatgaatttatgggttgatagattaacctgtcaccttggatagcaaaagctggttgcaagaattatgtggtcttccatgcacgtttgatcaccacatatggctgtaatttgaaagtttatgtgtatttctatctatagggttttccttaatgtgaagttttagaccagtagctcttgactgtgtagggtgtctgatttccaggtgtttggaggttgggtgttgattatgttgcccagttctggttaatcagtattaaagtattacacatgtgtgcatacccacatccatattcaaaaagaattttcagttatagcaactttcctcttgtaacgaatgttacctaacattgcatagaaaatggcatgctttaaagtggcatgttaggctgagctagctcattgaaagatgctcaataaatatttgttgaaggaatgaatgagtaaatgaatgaaagatgaacctgcctttctgggcagtgaacagaattcccttagatttgatctttcttaagtgtaacagaatttagctcctttgatctgtttgaagattttatatcattttgccctcatcattgtcgtgccttatgtcatcttgaaagtaacaggcctcaagaaagtaaggaggggataggaaatgagaagtgggaactgatgagtttatcccaggaaattgaaataatggatgagctgtatgctggcctgagtcactcacttggctgtgactggaggataagtgaatctgtgatttgacacacctaggaaaaggcaggaaacattagaacacatcatggagctgaaataaactttacaaagaaataacagcgtaggcttgatgattgcagactaatcttttgtctcccctatcactgttcagctaagggtaaggatttaaaaaataaagggtattgtttctagggctatacttaactatatgcaagaatttatttgacagtgtactaccagcttgttcagacattattttgatgatttattctccttaataatagatgctgtttttgtggtgtttgttactgggcgtttgccaattctgctgattgtattctgtgcttatagacgttgactaaggagatggttgctatggtggggactgtctatcaaaagaaaagagctcatagagataagaagcatgagttgtatataaaagaagtcacattgctttttgttgttgagttttggtgtattcatggggacctgacaagtaaggtaggggtttacgttcctttgtttacatgtaattttttttggtaatgggaagaatgaaagactgctgctctttattcacagagcatcaggcagtgtttcccagcatgtgggaatgtccaccactggtagtacatgagatgattttaggtgatttacagatgtttcttgagcttctcttgctggtcactgcttggcacagtccagaagacaatctgttttccccgatgcctgcttctgttgggctgtccactcctgccccacccattcactgtgggccctccttaatcccacccattcctcagctctctcttcgttcctacctctggtctccctcttctccttctggcatccctgcctgggcctcacactttgccctgccttagtttcttggccccagtatgtctccagcctccctggccctcatgcctattgtctgtcccttgtgttctttcaaggcacagctttatgctacctgctacaagtatccccattccctggcatttctctattatcctctaactaattgcccagcttccatcccttcttatgtctgtgctgggccaccttcgccccacagatcctgtgtctccaatcctggacttgcgcctacctgtcttccttgcctctaatcctgagtgcctttccctttcagccatgatcttcttttttctttttctcctacctttttatgtcaccttgcagtccactaatttcttttataaagaagcataagtaaaaaagagtcaacttaatatcaaggaaacaacagtgtaggaggtatgtggatatggttaaaatagtgacagaagtacaaaaattactgatgtttgtcattatgtcagcatctcacatgttgaacttaagtgatatgctgaattaggcttctaatttcttcttgatgcttttaaaaattgacacataataatcgtacatatttacgggtacacgtgatattttgttacatgcatacaatgtgtaatgatcaattcagggtactaaggctatccatcacctcgaacgtttcttatttatgttaggaacatttcaaatcttctcttctagctattatgaactatacaatatagtgttattaatgattgtcaccccactgtgctatcaaaccctagaacttactctttctgtctatatgtttgtacccattcaccaacctatcattgtactgtttacaccgtaagatgaacttttttagcttccacatatgagtgagaacatgtaatatttgtctttctgtacctggcttatttcacttaacataatgaccttcagttccatctatgttgctgcaaatgacaggatttcctttttataggtgagtagtattccattgtgtatatataacacattttctttatctattcacccattgatagacacttagattgattccatatcctggctattgtgaatagtgctgcagtaaacatgagggtacaggtatcccttgatatactgattgatctcttttcttttggataagtacccagtagtgggattgctggattgtatagtagttctatttttagtttttatgagaaacctccatactgttttccataacaactgtactaatttacattcccaccagcagtgtataagagttcccttttctccacatcctcaccagcatcttttattttttgtctttttgataataaccattgtaattgtggtaagatgatatctcattgtggttttgatagcatttccctggtgattaatgattttgagcattaaaaaaatatacctgttggccatttgtatgtattcttttgagaagagcctattcgggccaggtgcagtggctcatgcctgtaattccagcactttgggaggccaaggcaggtggatcacctgaggtcaggagttcgagaccagcctggccaacatggtgaaactccatctctactaaaaatacaaaaattagctgggcatggcagtgcgcacctgtaatcccagctactcaggaggctgaggcaggagaatcgcttgaactagggaggcagaggtttcagtgagccaagattgtgccactgcactccagcctgggcgatataacgagactcagtctcaaaaaaaaagaaaaagtctattcagatcatttgcccactttttagtgggattatttgggttgttttgttttgttttgtttgctgttacgtgaattccttgtatattctggatatcagtcccatgttggattaacaatttgcaaatattttcttccattctacaggttgtctcttcactctgttgattgtttcccttgctgtgcagaagctttttagtttcaacaagggtgccaagaacatatattgggaaaaggacatccttttcaataagtggtgctgggaaaatgggatatctatattcagaagaatgaaattagacccctatctctcaccctatacaaaaatcagctcaaaatggattaaagacttacgtgtaagaccagaaactatgaaattgctagaagaaaacatagggaaacccttcaggatattagtctaggcaaatattttatggctaagacctcaaaagcacaaacaacaaaaacaaaagtagacaaatgagattatcttcttgggactgtcaacattcctgtagctaccacaaagtgttttggattctggaccagaaaccagctgttctcacctctcaatgtatgctagaatcatctgggaactcttagaaagcgtaatgtccagttcctctgtttcaacacccccacttccacctccagccaattaaattggaatagctggaaagggggctaaacactggcattttaaagacctctgtaggtgattctaatggcagccagagttgagaactgcttgttgtcatcctttaacatggatgtcagagagtaagggcaaaaggaactctgttgcaaaataacaaaatgaacgaaaaacaagtcactacatgggaatagtaaacataggagaacacatagaacattgctaaggaacaaactgtgtaagaacgcaatcttttggatacacctcatgcaactgtctttacaaacttcaaccattttcaatgactttctagataaaccttgactttccttcatattcccagaaaagcaattgacctgtgtcccaggaggttgtttggcctcagcttgctttgggtttattgctctcagttcaggctgctgaggggtttggaggtagggatggtggtctgtcactgtagatgtcaaaaacctttccttccttggttagtataactcatactaggaaggcattaggtgggcattgtccatattctgccagaattagagaaagaaaaatcgttttctgccttcaggataaatgggaggtaaggagaataactgttttcaaggcttcatggtgttgggctctactttgaccaggaatctacttgggtttgtcactaaagttcacctctccctgtctggccattctttgttgtctcaactttcaaatctcccaaacattccaagtcaaggattgattctgctcaggtgcaagaagtcaagaggcagctggacctcatggtcttggttgtcagggtaccctgatctttgtgctttccttttcctcgctctcatcctcaccatgcctgcagcctttttctggctcctcatcttctatgtctgacagataccctgtctttgacttgctctgtcattggcttgcctgctgctcagctatctgcacagctctggcccctaaccaggtcagacttggtatctgtgcttaggccatctgcttgtaactggtccctagcctgccatggactctggatacccactgtggtctggcttaccctgttcttgttaactattgcatatgtgtgcccagcatgatgtgtgggttctttgtgccaacctttatgacttgttccttctttcttatattcagtgggaaaaagaagagaaaagcacgcagcatgtgtatgaaaagcacattgggtgattctgctgtgctagggtttttctaattagaggagtttgttttaatcaccttctcatttgagccaaatattcaggtaatacataaagaagttactttaaattggcttttatagtcatctatgtatatatacctattagagttatttaattggcttttggcacaagatcactttactaaagggaccaggcctcttgtctaataaagagtttgaacacacacccgtttgaaacaccatcacagaacaattccctgttgttctataccagagcctcaccagcaaccttcatattttcttgtgctttctcttgaaatgccccaaacctcctcttcttatagttaatccacattcttttccctcccaacctcttagccctgatgtcctccagaaaaatatcccctgactgtacctggttccgttcagagactcgtggtcactaggtgcatggctagtgttctgtaattcacaatgtgctcctgtgggtagtaataatacatacctcaggaggttgttgtgagccttgaaggagctaatatgtgtgacccgtgtttggtaccagtaagtactcagtaagtatgtgcttgttttctgaatttttgcagctttaggaatcttagtttcttgtcagggataatttccctccattaagagtggagtttccctgagggcaagcccttgtccccactatcctttgtattttcacctagatacctaattcaaagttatatcctaataggaaacctaataaataactttggctaacagagtatctgaactctccagggaaccattgattatcacagcattgttaaggaggaaaaagataaatgtaattatttgataattccaaatatcttacccctttgtttctcattatgcctttctgagatagatcatatcacttcccgtttcacagataggaaacaggctcgtagagattaagtgcttggttaaagtcagagagctgctaagggaaaagtcaagatccaggaccccggactcctgtctaggatgggttgccccctctacctgctgccatacagatgggaagagctccatctgtctgtctctccagcatgcatgttaaactgggagcccagccaccttccctgtcagcaggtagtagagcgtatcattgggatgtcttgtctgtggtgtgaactacccaggcaagatgtatctaggccaagtcctaggggaaggacactgatagctgctttgtgaggtcccggtgtggtgtttccatccagtggggtggagattactgtgatgtgagaacagtaaagcagcacttgcccagatatggcatgtcctcccagggcctgttctgtggtggcatactcagtggttgctgagaaccaaggggcagtgggacagctgtgtccctggatattcagaaggctagttggatccccagtataagtgatgggtttgctcttcaccttgtggacagaggtggcttgttatcaaagaaaacaccaaagcaattagtatcgttgttgttattagtagcagtagtaatagactctactaagggtccaggtagagcagggagtgattagggttaggtgtaagctcgctgcccttagggagcttacaattcaaactcctgaaagatcaagaatcaacagtaaggctgggcgcagtgactcatacctgtaatcctagcactttgggaggccgaggtggacagattgcctgagctcaggagttggagactagcttgggcaacatggtaaaaccccatctctactaaaatacaaaaaattagccgggtgtgacggcatacaactatagtcccagctactcaggaggctgaggcaggagaattgcttgaacctgagaggtggaggttgcagtgagctgagatcacgctactgcactctagcctgggtggcagagcgagactccatctccaagaaaagagagagagaaaaaaaaagaatcaacagtaacatctctgcatctctgttggccctctttcaagtgatacttataagggggagctcttctagctctaatgtttcatggttctgtgtggacaatacctacaaaatatttacctataatacctataatatatctttgtgatgccgcaggtactctttcatgttaagttgctagatgagtgctatgaatttacaagagagaaataattgggtctgaatgaaagaagaaatgttcatgtattcaacaaatgtcttctaaggtcctactatgtgctttgctctacccaaggctctggaaatacaatgctaaagaagacagtcttcttgtcttcgtgaagtgttatggttcaatgggggaagtagacaataacaaataacacaatagataatgcaatgacaggataaaaaggagagaacagggttaagctttagtagccctgaattacgaggatggaaatcagcaaatacagggtgtgcttggggaatgaagactaaatcagactgcctggagcatctgtgtgataagagttaaggttggagggacagattggggctaccttgtgaagattcttgcattggcatgttgggttaagggcaaatggttccagagttgtagcattcaattagaaaaggtattgagcagtaccaaggtaccagccagtagactaagtactactgggttcatatggtttaaggagagactcagatgtgtaaaaaggaccttacaacaaaactggtaagtgcaattacctaggcttgcataggatcacagaggacagaacagctaattgcctagaggggttggagaagtaagtcttctcggaatatctgatagttcagcttggggtgcaggattaataggagtttgtttggtggagaaggtggggccaaacattctagacagtaaagcatgggcagaagcacaaagtgggttgaaggggatggatagctaaagaaaagggggcaggtcagtgtatcaggaaggtaaggcacacaagagggagcaagggtcatggggaacttctgagcataagagcctggtgctggtcatgttctttaaagatgaatctgaatgcataaagacaactggagaaaaagaaaatggatgtgaaggaagcattggcctatggagaggaaggaagagaaggatgtaaaagataatgtcagagaaagcaacagggatttcttactcttcatattaaagggtcattgaagctttcatgcttaggtttgacttgaggagtggcaactgttacactaaaagtctgaaaagatgagtaggacttggggtgttggtaaagggatttagaaactttgagttttagatgattacaagatgcctgattcattcatgcattaaagtaggtttgtgtttctagggggaagtcagggcaggagatgaatattttgagtcatttgccaagaagtgatggtgaaactggtattagctcaaggaagacagcatagagaaaagtgagagtagtgtagactgtttttcgaaagtattgacaagggagacaggataagagagatacgaagagtattccttaagggtaggaggagagccaggacataataatttcgtgggaatagaggagaaggagagttagggagctccatgtgcgtggagaggaggcaatgttgagggctttggtgacagaaggcattggtgactacttacagcattgtttcagcacctcaatgagaagaaaccagattgcagtgggaggaggtggtgaagatgaggtagcagcaagcacatattgtttgtttgagaaatatgtcagaaaatgaaaggtaaaaatagaatggtggttggtgggacattagggtcaagtgatgattttgttcaaggaggaaggcctgaatgtgtttgaggctggggtaagggaccagtgatagaagtttaaagatgacaaacagaaatgaatttatttatccattcaataaatattcattgagcactgacagtattccagggacagtgctatttgctggaatataacatgaataaggcatgaaatcttcatggagtttacattctagtgactaaggcagacaatacacaagtcaaagtaacagttgaatttgcaataacagcttgtgataagtgctctaaagtgaagcagtgacctggaggaggtaggaatggattgaacaaagagtgcagatggaagtggtagactggaggagggggaacacttcctctgttgtaaggaaggaagaaagagtgcttagaaaatgatttttaagtagaaaaagtgaaaaatgaggaaatgcagttcagatggtcctgatattcttaaaaaagaacaggcagtgtcatgagctcagactggagaggtggaatagttcaagaccttggataggtgcttactgcttcattcaaacctccgatgaccctgtgatgttgtgggagggtgttattctcattgtatacatgagaaaactgaggggactgagagaggacccatgactgaaaagtatagcagcaagggagaggagcctcacctggatactcttatcatcaaactcacctccaagggccagctcagagggtactgtcagtgcaatcaagacatcagttcctcctcccttctatataaagccttgtgctgggccttggagaagactgtggagaggagatgacacctgtacctggaaaataagaaagatgaagttggaagagataagatgaggaaactgaggctcaaagaaatgattttactccccaaagtcatacaattatcggctgagcctggatgtgaagccagaataaaaaactccaaattgagacctctttccattatattccccgatatatacccctttactgtgctcagtagccttgatgtagtcattgtatgtggacagaatggagaattcatgtgtttgagggttatctggtttgggttcagcttttaaaggctccaggcaaaatttctaagaagctccaaaagcaggattgcatttctctatccttccttgttatcactatgaaaaataagctgagtggggttgcaagtggcacttcttggttctcctgggctgttgcagaattgtgctctaaagaacccagaggagtatcttccttataaacccaggataggaggaataattggcatggggcttttaatctactttcatgctaaatgaaatctgttagatgggataatgagctccatattttatagactattttaagcttgtctcaaaataaagtacagggctaggggtggaggaaggacgttaagtcttagagacaaaatgccatggcttactcatcagtgttttcattttaatgatcccaaccccagtacaagtccctcagtgatagtgtaatggaaaccacattttttttttcctgttggaagtttcaggatgaacacagccaaatgcttcaagacataattaagactacaatctcccatcctcggtaatatacagacctttcacccagggggctcagctagagacaatgtggttggaacgcagttgaaattatagagacttttccccaccaacctggccccctagagcttcttttctaggccttgtcctccctgtccttaactcccttctccttaactgctgcctcatgcctgggaaggaataaataagtaagaaccctggtgttgactctttccctgccacagggagagaatcccagacaaatgctgctgtgtctggaggaggctggactgcgctggcagaggcagcacatacatagcaggaagggcagccaagagagcttgccaacagatgtggggtgctgggagggaggaggtagacagtgtcatcattaggtatggaaggaggtagggaatgttctgtacattacaggctggaaaatccagctcataggaaggtcttgaggacttaagagagcaagacagctccttctgtgtttggacagaatgggtctcctttgctttggcaagctttctgaacctacacagatcagagttaacaagcttggcatgaccaatctgattatgtggcttctccgcccctcactctgttaatcacatcttgaacacctggaatatataagataatgggagcccacagtacatatatgtgtatactgtctgtttggccaattgcagtccagtcttatccttgcagggaaggctccacttagcacaaggaacaaaggaaggattaggatatttgccccttgctaccttggttccatactctgccctgggggtagtgattctgggatagccaaggataagacccaactgggtactctgcttggctccttagagatcatatcactggtacatttctcttctcactactccagccaccaaaaggcagatagtcatgttaatatctcctccaggaaaatgtattaattagtatattcttgactcatttaactagtgactaaatacttttctgagtctcagtttctttattcagagaattaggataatatctacctgtggtagtcattagtaccattcattaagtacttctagctgcctacatgtttgggcacacagttagattgtacttctctacatccttggtcatgtgacctgctttggccaatgaaacgtgagcagaagtcaggtatttcatttccaagtggaagctttaaaagccaatatactgtttacttccttccattgtttaattgattgtagctctgttgggataaatccttcatcagcctgggactgtgagtgactatgatgatcacagctctctactgaaccaagttgaacatgtagtatgagcaaatattaatcttattttctgtgaagttactaagatttggggggtggtttgtatctgtagcttacctagcctgccttggctgataatatactacctcataaggctttgcaggggattacacaaaatgcgtatgtacacatagtcagcactcaataattggtggctactttattctcaccatgaatataatttgggatgcttttggctgcaggtaattcaacccaaactcaaaatgcataagcaataaatgcatttctcctcttgccttcacttctcctcctgcttctccttctcctgcttctcttaacaagaagtttagaatttgggcaattgaattagaggctcaacatcatcactagcttctttcttatttagtctgcctaggttaattagatttcttaaatctataaaatgttgtagttcgtcatttttggaagattgtcagttattatctctgttctttttcttctttccatttgagatctcaactgattgtatgttgcaatttctcgttgtatagtctatatttcttattattctagatatttttatctccctttgatgcattctagataatttcctctgacatatcctccagtttattctctttttagctgtgtctaatctgcaattaaatgtgttcactaacttcttaatttcaattattgtattttttagtgctaaaatcccttccctatttaattatttcccaaatcacctttcttttggtttccaattttatgaaaaatactttcaagcttatcttttgtttctttgagcattgagcatagtaagcctatttgttttatagttttttgtttgataattccattatctgaagtctttatgggttgattttttttcctggctttattgagataaaatggacaaataaaaatggaatatatttaccatgtaccacatgatactttgatatacatatcatatatatatcatactttgatatatatatgacatatatatcatactttgatatatatatgacatatatatcatactttgatatatatatgacatatatatcatactttgatatatatatgacatatatatcatactttgatatatatatgacatatatatcatactttgatatatatatgacatatatatcatactttgatatatatatgacatatatatcatactttgatatatatatgacatatatgtcatactttgatatatatgacatatatgtcatactttgatatatatgacatatatgtcatactttgatatatatgacatatatgtcatactttgatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatatcatactttgatatatatatgacatatatatcatactttgatatatataccatgtggtacatggtaaatatattccatttttatgtatgtatatatgtatatatttcatatatacacacgcgcgcacacacacacacacacacacacacacattgtgaaatgattaccacaaatgtgggtctctttctgtattctgctattcctgatgatccttcttcatggtatactttttccttgtgttttttatctttgtatcttgatcactggccttgaagccaagaatgataacattcttctgcaatgatttttattttcttttgacagcccctgggataccaccagtccagttctaccttaacaaaatgcttaagattccttcgacctaggttgcagtcaactgggtttcaggtttgcattaacagctagtttattctaggctacctttatcttgagggtgaagcttcccctctgagaggaagcctagcttagagtgaatgttgtttatcaaagtcttctggggcagaggccctggatgttgctttctgctttcctactcctcctggttgccaaaagcacagcttagttttgctactaaactaaatactattgtttcttgcagattggcaaatgctctcaaggcaaaagctttttttgtgtgttttgggccttcctctttggattttaaacttctcctaggttttgacctagaaattctttatcttgttagctctttaatgcttttgagaaaataaaaacaaatataaatgattgtcctcagtgggaaggttggtcctaatcacccagcctgccactacaagaaaagaccatcttagaaccccaataccttacatctttccattctaccatcctgatagtcccaagatggctgccgtaactccatatgttacatgcagaaccgataacaactgaaagagcctgtttcttcatgcatatattttaaagcaagaaaacctttcccagatgtcctccaggagatgtttcctcatgtctcaaaggccattattttgccaccaattccaaaacaagtcactggaaggggatgcaatttccgtgattggtgtaatgtagtcagcatttaccctgtgggactgaagttgtctttgcgtcccctgaagcacatggatgcttgatttcttaacaaaatgtgggtctgtaagcaaggaagaagggggttaatggccactgggtaggcaaccaactgtgtctatcacagtctgtgctcaggattaaagattaagaagcatagtcatggttcttgttctactttgagacctacgtgctctgaatggtgcaagaaaatatagagccaaacgtaatacagaaaggattcataaatatagggggcatgttcattgaaaacacactttgtaacttaaaaactggaaaaatttgggatactctgtgttcaaaatataataaatttatttaatcaaaaatattaaaaagatatatagcaggaagaatggctttattggaaattcactccccaaacttaatcatattacaaattacttctataaatgcatattgtacaaaataggaatagatctgatgcagtcatgattccactgaatgagctgggtccttccaagtgctcctggtagaggtgggctgcagtttgcagaagaaagaaaatattaaggcttaagaatcctggccgggcacggtggcacatgcctgtaatctcagcatttgggaggctgaggcgggcagatcatttgaggtcaggatttcgagaccagactggccaacatggtgaaaccttgcctctaccaaaaacacaaaaattagtcaggtgcagtggtgcacacctgtagtcccagctacttgagaggctgaggtatgagaatcgcttgaacccgggaggcagagactgcagtgagcctagatcatgccactgcactctagcctgggctacagagtgagactccatctcacaaaaaaaaaaaaaaaaagaatcctccaaaaacttggaaacatgagcatcccttccctagcagggcagaaggtttttcttgatctaatatacctgcctttgttacctgggagcaggagaccacagaaggcgaggtatgaaggtacaaagatgatcttttccaagttctggcttgctcccagaagttcagaaaccagatcctcctgtttggacaagaggccccagagagagataggaatttatcctgcctgtccccaactgcaccactggagtatctaatgagcagaggtccaattcctgaacactagccttccacaggtttggggtccatctttccaccttctgttttccatatcctatatctatggcttgatctcatcttagaagtcccccttcctagtttgtcatttgccacaggttgctagctcttgaaagtccctcaaagaagatacccaaaggaagtgtgccaagcaggttgaaagtaggcatggggtgatatttttggtcacgagcagctgagtacagctgggttttgggggagggtggggacaagtagggtaaaagtgaattgaaagtgtatctacatgtacttgtagatatactttcatgtactacataactgcatgtctcctttgattacctccatgccgtttcattcttcaatcccaccagttaaagctgttgatttatgtaccagactcctttaaaaaaaccaaaggaaaaatagttaataaattcggatgtgtcaagcccagtgacgaggtttgtttagctgattggcttgcttttcaggcagtatgctgagtagttaagtgggaggaggctttgaaataaaaacagcctggtttagctcatagctctaccacttactattgtgtgacactgggcatgtcacagcctctctaggccttggtttcctcatctgtaagatgccaataatatcctatgtttaccttatagtgttattgtaaggattaggtgatgttacgcatgttaaaggctcaataagtgttagttattaattcttaacctgtattgcctaaaatctaacttttggatgagaaggggatggtggagtggttataaggtgctctggggactgaaggcttaggaaggcaggttttgaaagggtacggagatagaatatgcatgtgaggatctgggctttgaaagaggataatcaaaagttgaattggaagagagtcgatgactaacttccatttctcttgaagtgtggcccaaggccctgggggaaacttcagcttcaggctgtacctgtgtacctgcttgtgactgggatatgtttcctgcaggagtgaagccattggtagtttcttttaaggccccgcctcctcacctggagactactggccaggtggctgagctgggctgcctcagagggggcaggtgccctgctatctcctgctggctcagcctgcgaggctcaaggtacatcctgcctcactggagttccttctcctaagattaagagcttgagtggcccagcccagaataataaatacatgaactggcaggcattagaaggcgtcagcatcgataaatcatcatattctgggcagtatcttcagaaacccgttcttatcaaccacttaaggagagaaggatccaagggccatggtgaatatctgtctcaacccagaaaggaaggagctgaggcaacagggtctttggtagtgctggaagggtagagagtaggccctgggtggaaatatttttaaaaggagaaaggtaagagaaagggttaaaaggcagccttttgtcaccacctcaggcagctggatgagggaccaggcttgagggagcaggttggaagaacagttatgtagaggtagaagtgtaacttcagtcttcaaagtggccattatcggcatttggatatgttctggccatttcatcagagaggcaagcaccccttggtacctgtttgtatgatggatttggatgggaggaagagagaaatgggatttggggataccatgagctctttttcccaggggttcttctttagccaatgccgtgggctcacatctgagccctgaggagaggaaccctgtgcaaaagttgaaggagctgtctgctgttttcatgagggctctgtgtgacatatggggacagatgatgctgatcttgtgaacacagtggggaagatggacttagcttccatcaaggcttgatcctggcatagtgaagacttcgggaactcaggctacttggcacttggaatattggggatttgagaaccctggagcaagcactctggatccgacactggtgtcctcacagagggcaccccaggcatcctccagcaacagcgggcagccagagcagcagaggaaggacatggcaggtacggctgacaatgctttgtgagcaggaatgagcatggggagatatgagtggggctcctggacatagtgagatgaaacttttcaggggctgaggtgcaacatgaggaagaagatcaggccaaagccagtggaatttggattgcctctgttaatgggatgtcttgtctggtgaaggctaggaaactcaagtcacagaagaaacttcccgtcagtgaggtagtattccccaatttaacaaatatgtattgaatgcctaccctgtgcaggcactattatgagtgtgaacaagagaggcagaatctttgtcttcatgagaatgacagtgaagggaagacattacccagttagaaagtgccatgggagcagagaaaatgaggaggagaatttcagctgtggatttgatcttgaaagggccttaaaggatgggtaaaagttgggcttgtggagatagaggaggcctagagaagaagggagaatttgggaaatagtctttatgtggtggatgtgtgtttatacacattgtgaatgtgtatgaaggagattaggaatattgagagagaaagctggaaaggttggttgggtgggctttcggtcccatgctaggattttattcagtagtctatgggcagccattgggatattttgagcaagaaaagtaacttgatcaatcatttcctgcctttggctgaggtcacttagcagcactggtgttaggcagggctgcaggccatgattgtttcgatatgttctcttcctggccttctcacgggagcagtcgtaattttatttttacccacttctctgttttgggcgtccgtcagattagcagctagctctatgcctccagttggaagagagcttctgttcaaagtgctgtatgggtggagtctttctgccactgtccgagccctgctgcccttcctgggtgttgaccttggctgtagagggtgtgtcccttgatttaaagctatttgttcccccttctttttcagcttcaccctggtacttctgaatgaccagggttcctgcagggaggtcgagcaacggcagcttgtggtttgggtgttagctaggggcagcaactaataaatgaatggtcagttgtcttgggaatgtaggtctttgcttcaactagatttactttcattttatcataaataccagaagcttcatgaatttaaattggtttcctgaaacagaccctggttccaggaacatttctcactgtgggagacaggattgtcaacaaaaatggggatgcatttttaaagataagatctatttatcagtgtatggtccacaaagaatcaaatttggtgacttaaaacttctgtactcaaatgaagggtatggtgcatatttatcttacagtgacagtgatgttttagaatatccgtatggtactgctggcttagttggcctggatgttatattcatgaggccaaggctgcagcccagctctcttccctctggtggccagatatcttctctttggtcatggctagagactacatcttctgttccagctggtagtcttttagtagcattttattagtcatgcaagggccagcaaaaatagcatagacagatagtaaaaatctagtccttgtactggaaaaagaacttggagaatgtggcctgttgataatggttgtattatcactaagtaattttttttatattgattaagtacttcctatgtgccaggaactgtcctaagtgcttatctcaaccttcaaaatagtatagatcctatcttacagatcaggaaactgaggctgaaataagttaagtgacttgacaaagtcattcagcctggataatggtatgcataattaggttctaatctagcttttcttatcttaagtcttgtatcctttcctctcttctgtccagaaatgatgatgagaatatagtagttcccccttatctgagggggatacgttccaagatccccagtggatgcctgaaaccacagatagtactgaatcctaaatatactatgttttttccctgtatgttcatacctacaataaactgtaatttataaattaggaacagtaagagattaacagcaataactaataataaataggacaattataacaatataatggaagttatgtgactgtggtatcactctttctcaaaatatcttattatattgcatcacaggtaactgaaactgtggaaaataaaaccacgcataaggagagactactgtacctatactgtagattcctggaggcagagtcagatgttggactgttcagtaacatcttggaatctcctttgtccaccaaagtgtctttgactgtgaccttaggcctcttgctttgaagcagagttactctatcctatttggagtccaaattaacatctgctcaccaccaagtggatccctggagatctttcttgctgtatcctccagcccctagccccttttgaattggggaagtggcagatggaagatcaagtggcagatggaaggtcagatttcagaccttgcaggcttccttctgatctgcatcagctcagagggagagaaggggggactggctggtgtgtggtcaagtgtattttgttgacctgctgccctgagctaggggtctatactaggaatttcttttatggaaaagaaaaacagtgttttttttttttcccttgaacattctgggggtggggagaatcagcaaattattttatatttaaataactaaacatttattaagggtcatctctggagaagacagaattggtgtgatttgaaggatgctacaaaagtgcctcctgctcagaacctctctgacccttgtagtgctttgacaccttaaacagttcattcattccttttggctaatatcactcagctgatccttttataggtgctaaaataatgcactcttgtgttaatttaagattcttccggaagaagtagaggaacattaaggcagtgtgtgtgtcgggggagtggggtgggtggtgtttagagtgaatggatgactcagacttggtgagagatattctgggatggcttcctggaggagagaattacttaacatgatgtggtggccaagaaggctgttggcaccgttctttcagaagcttcagattgaggcattcaccaagttactgaacattagtttttagtttctaagataatggaattagctgtagtagtacaaggtacaaagccattattaacttataagcctttataattacttttcagaagccctttttgctttagcattgtaaatctttctcacagtgccagggatttaaaaattttagaaatgacatttaattaatgttgaacgtaaaatctctttgggttttaagctgtcttgggaatctactcattccctcctcccagatccatcttgcctcctcttagggatcatccaggaaacctccctgagggctggcatggaggtaggcagaggagagtgccttccctcagggtgactgtcagactttccagcccccagaaacattccgtggagatgaaggagacacttccatctgtgcctgggccatatttcagggagactacgtggtgggactcgcagctgggggacaggacagagggactacagatggcagatggctctggctgccacttggagggggctgttcttggggccgatgggggtgtgtggcttagactatactccctgtgaagtaaacagggaatgcttttcttaggatctagggaagttttagcaacttagttaggattatgccatctctgtgggagagagggtttctgcaggagactgcaaagatatacatgtgaacatttaaaaagtacaactttccagcccccagaagcattccgtggagttgcaggagacacttccatgcatccacagaagccctctgtccctcacgtgggctctggagattcctaagacttctgtgcatctctctatgtgagtcatgggacatgttcccttaggccacatgtaaatgccaggcagtgaggcctaaatagtcattgcactctaaaaaaagtaaacatatttaatttctcatatttttataacgatgtcttacttgaacatttattatataccagatttgttccaaacactggaaatccgtcttctcatttaattgtcacaactctggcaggtagttgtcattctttacagtttataaagcatgtccaccatctatctcacttgagtctttcagcagtatatgtatccccattttacaagtaggacgtggccagataagtgactgtcataagactgtatgtccatggagtagtgacattgaactcagagctctttgttccaattccggtctccttttcatcatactgtaatgagagcccagctttcttccttctctcaacccccaccttgttttacagagagtgtctctgggattctgtggctgggagaggtgggagaggtagctgagcaggtaagccttttacgaatgtgtgtagatttgagacctgcaaggcgagaggcaacagggagtggaagctgactgacagggccctgggggatgtgtcagagacagtgcaactgttgcacagatgtggtgcaggctcctcattaagagggagctggaaaggaaaaactcccacttcagagaagaattagactgttcccaatgtcttcacatctgtgaggggactgatggtacaaagactcactgataaatggacagaagttttcagacccaagaagatattaaaataaatatttaatttgcaacaaattatgctgtgaatcattaagacaaacataaatctcatgagtaagatttctgttatttctctgaatctcaatgaaatatttattgaggaaaatgaagtcagctcattgctttgcatgactaaatgccattgctggcttccaagagcagcttcctcaggatctgtctcagatcgcaaggatgggggaggaggcaggactacttccaggctgtcccaacatgagcagggatcagatcattcagatcgggtaggactgaagcatggtctagcattgtgtctggaatagaaaatgttgtctaattttttgttatttaaggttgattttgaaggtcctggggcactttctaatttgaggagtagggaggatggcttcagggtaagttctctgaattttcagatggcaaaccctgagacagctttcaagtgtgtctagaacttagaatgctctgattcaggttaatgcctttgggggtgatacacggatgtcctgatgccattcctgggctgctgcttgggtatgctttaccaatgctaatggtgtgctcacaccttggggattgggagaacaacatcaatccatctaatctcacctaaggtagtagaggatattgacccatctccccacagaggtcagccccagttcactgactttcttagttgtggcttatcagagcaaaactggctattctaggagatggatttcaagaggctgaaacaaaagacagcagtgtgggtacatggggtgatgaggatacccaggccttcctggactggtttgggctgtagccgttcccccgacagggcaggtggctctgactcctgagttcatggtcctttggcaggcagatccagtgtgggtcacatgatggatgtttctatgggtggtcttgctgtccaaagtcagccttgctgctctaattccattctggttttcttcttgcaatccacaggtggtttaggtaaatccccacagatgaaatatgactttattcctctctcaaaaacacagtgctttggtcagagagaaagcttagcgagcatgttgaggggactgtcacttagaactgaccatcttgttttcctttgccttagacttcccattttctaaatctagagtgcgattaatggtataaatgtagaataggaactcccatttctagcagaattactgaatttaactaagtatgtactgagaatgagccatgtgcctagaactgtgctgatggtctagaagatacagaaatgtgaacagaagaatccctacttttcaagaaacttacaatccagataggaatactaaaaatatatatatatatatatatatatatatatatattttcacataattagctaactattcattcaatgtgtatttatgcagcaccttctcttagcagaatataaaagaattcagaaatgctcctgtaatcccagcactttgggaggccaaggcaggtggatcacttgaggtcaggagtttgagaccagcctggccaacatggtgaaaccccatctgtactaaaaaaaatacaaaaattagctgggcgtggtggtgcaccctgtaatcccagctgcttgggaagctgaggcatgagaattgcttgaacccgagaggcagatgttgcagtgagccaagatcatgccactgcagtccagcctgggcaacagagtgagactccatctcaaaaaaaaaaaaaaaaaaaaagaaatcagaaatggctacttaaaaagacatgttaataattattttgtaaaatgaagagtaatgtgagttccaggagatgctatctgtgaaagatgcaggagtataaacagtacttctattagtagactagagaatgtagccaccagatagaggttttgattgtttatattttctatctccagaatctagcacaatgtctggtatacagtaggtgctcaataaagaaatattgaatgaataaatttttctaggctggagtaatcagagaaaagctacctcatggaagaagtcaagcttgagttagatatttaaaacatgacagaaattgggtggcagtggagagggcattttaagtttttcagaggatatcattgccatgtctacagtactgtgttatttatttctctctcatatttgtaaaatattgcacaagtcacccatgagcactcagctatttcttatctcctttatcagaccattagggaagggttgactctggggcccatggcacctggttgtatgataaaatgcaagaagtggtgatttatttctacttgaagaaacaattttacagtttggggatgcttttgcagccctgttcaaagaggctgtggattggaattctccataaggccattaattattgaatttgctttactgtaaaacaaaggagctgcttataggtgtcagctgttgaaggtgcagagtgacttagtagcagtataagtgctcctcctaatcacaggcagacctgttagcagacactcagaaaaaaggacaggatactgtcagcacattgcttcagggaagatgggcaattagtggcttcagatgtcacatagcattcttctccttttggtctcccaggtgctctctgttgggcaatcagagattttagttatgactctagaaacaagtcccagtgagagaattttgggctttgcacttgccaaatggtgagatgagtggtgccagagagtttggctgcggtggttgtgatggaaattctgcaggtggtggtgctaaagagaaagagaaaaaattcctggctgtcatggaagatagttgctttctgggcagtggagctggatataccagtgcagtctgcagtgctggtggaggctcaattccactctgctgctgtgattgtgtccttcagcacactctgaggtcctgatctgctctcctgtcttatatgtaggggtgcacaaagccagactgcaggagccttcttggtgggcatttttataatgatatgcatgaaagcttgacttctgagtgtataggcattcctcactttattgcactttactttattgcacttcacagatattgcatgttttgcaaattgaagttttgtagcaaccctgcattgagcaagtctatcaacactgtttatccaatagcatgtgctcacttcgtgtctctatgtcacattttggtaattttcacaatatttcaaactgtttcattattattatatctattatggttatctgtgatcagggatctttgatgttactattatgattgggggcaccacaaaccatgcccatataaaactgcaaacttaataattgtgtgtgttctaactgctccacctaccagctgttttctcatctctccctctcttctcaggcctctttattccctgagacgcaataatattgaaattaggccaattgataatcctacagtggcctctaagtgttcaagtgaaaggaagagtcatacatccctcatggtaaatcaaaagctagaaatgatgaagcttagtgaggaaggcatgttaaaggctaagatagcagccgggcacagtggctcatgcctgtaatcccagcactttgggaggccgaggtgagtggatcacaagatcaggagtttgagaccagcctgaccaacatgatgaaacccagtctctacaaaaagcacaaaaattagccaggcgtggtggcacgtgcctgtaatcccaggtactcaagggctgaggcaggagaatcgcttgaacatgggaggcggaggttgcagtgagccgagattgcgccactgcactccagcctggacaacaaagcaagactccatctcaaaaaaaaaaaggcaagataggcagaaagccttgtgttagactgttagccaagttgtgaatgcaaaggaaaaattcttgacggaaattaaaggtgctatttcagtgaacacacacatgataagaaggggaaacaactttattgctgatataaagttctagcgatctggatagaagatcaagtcagcaacaacattcctttaaaccaaagcctaatccacagcaaagcactaattctcttcaattctatgaaaggtgagagaggggaggaagctgcagaagaaaagtttgaagctagcagaggttggttcatgagactgagggaaagaagcagtctttacaacataaaaatgcaagatgaagcagcaagtgctgatgtaaaaactgaagcaagttatctagaggataattgatgtagaagtctacaccaaacaacagattttcaatgtagatgaaatagccttctattggaagaagctagagaagagaagtcactgtctggcttgaaaggacagcttgactcccttgttaggagctaatgtagctggtgactttaagttgaacccaatgctcatttaccattcccccaaatcccgaatccaagaaagcctggatgacagtacatctgtttacagcatggcttactgaatattttaagcccactgatgagacccactgctcagaaaaagagatccctttcaaaatattacttgctcattgacaatacacctggtcaccccagagctctgatggagatgtacaaggagataaatgttgctttcatgcctgctaacacaacatcctttctgtagtttatggatcaaggactgattttgactttcaagtcttattatttaagaagtacatttcataagactattgctgccatagatagtgattcctctgatacatctaggtaaagtaaattgaaaacctgagaaggattcatcattgtagatgccttaagaacatttgtggttcgtgggaggaggtcaaaatatcaacattaatgggagtttggaagaagttgattccagccctcatggatgactttaaagggttcaaggcttcagtggcagaagtaaccacagatgtggaagacatagcaagaaaactagaattagaagtagagcttgaagatgtgactgaattattgcaatctcatgatgaaaattgaatggatgaggagctgcttcctatgatgagcaaagaaagtggtttcttgagatagaattgacttctggtgaagatgctgtgaacattgttgaaatgacaaaagatttctgtaaacttagttgataaagcagcagctggttttgagaggattcactccagttttgaaagaatttctactgtgggaaaaatgctatcacactgcatcacatgctgtagagaaatctttaatgaaaggaagagtcaatcaatgtggcaaatatcattgttgtcttattttaataaattgccacaggcactcccaccttcagcaaccactatcctgatttctggcagccatccacattgaggcaagaccctccaccggtaaaaagataatgaattgctgaagattcagatgactgttagcattttttagcagtgaaatatttttaattaaaatatgtacattgttttttagacatgctattgcacacttaatagactacaacatagtgtgaacataactttatatgtactcggaaaacaaaaaattcatgtgactcactttattgtggtggtctggaaccaaaccctcaatacctctgaggtatacctgtatatggtaatgcgtgggagagggtttgcgtttaacgttgtagggacaaggcattcagtgcatttaaaccaaatcttgctgagcctacagagtggggtacaaccctagttcagaacctggagtataaggaagagacatggcctctgtaccagcaacagaaataggatgatttacaatttacaaaagggtttcacatgggttatctcatttggaatccacaatagccttctgaatcagtaaagcaaggattatcattgcccttttacagatgaggaaactgaatctcaaaaaggtgaagagatttgcccatggcttcctagcaacaagccttgaatctaggaccttggattacaagtttcctgctctgttctttcatgttagtttctaatcatgagaacagacaactacacatgaaatgactcaaagatactgattatcatgatgacaggagagtttgaagggaaggaggaagcccaaggtcagagatggtgtagtgaatgagcaagcctccatgagctggtgaccttgagctgtcacacagatgagaggaagctgtgatgtggtgggtggagggctctggtgccgtgcctggcagtgcaggcagtcactgtcttccaggcccactcttccttattcctggacatttgagggagtctaagggaggtccagaggaaacacaaacacctcattttaacttacagtataatcccccttcctagaaatgctttcaacacagtggcccacaaaaagtaaaatgacttggagtcaatttcttctactccttgcctttgattcccctgtgagtggcagggaaatacttaggaggagtaaagaggtgttgttaagagcctggatgattcagagttaggccatcagatgctctgcttaattaggagtgggctgtcctgattaggtgtttctgctttgagcaggagtggttccatgagttagaggctgcgtcttggtttgcgtcctgactctgaggcaggtttggaggaaaaggaggtgactctaccacctcatacccccaaatctcgacagcttacctactaacattctcttctgactctaggttgccttttaggaacatctgttttgccttcatcgtttgccttgaaatacaaaatgttgaataggagagaatcatggttttgtgaatgtctggccaagaattgggagagatttccttgcttttaccagtcctcaacttaatgattctgtttttttttctctattaaaaaaaaattaatcatgagtgaaattttccaaacttgaaaagatatatatcaatcagaaggatttttcagtaggattcctttatttttttcctcaatattatgttaagaaatacctgtaacccaatattacctcaactgttttctcagcgactgttggtcagatttctttctttcaatcattgaaatttttgcaaagtctgagcaaatatttgaggcttcttcctgctccccaccactcctgcatcttgagaggtggaaaacggaggtttgtgtgtggtctcaggacatcccctggccactcttctcctttggggtgatttgcctccatgttttaaatccaagatggtggacatagatgacatccaattataacttctttctgatttggggcacaaggccagattctcctaagagaatttacacagtcacaagtttggaagaatttctcatgatgtaatcaagatgtaaaagctatttccttgctataactcatgtacagtttcttgtgaaaatgaaatggtccaagctctgctgtaccatgctctccaagtgacagtttcatctactccatatgttcacagatgagggaatcattgtcacatggcaaatggccaagaaagcccctagcccacttctgtagcttgtccaagagtgcctggcacattccacccctcaattattcccatcaattgtgaacagatgggcacaatactctaagtcatagtaaagtgacttgtatctggccattatccaagtgaaatgaaagaaggtgctgttgtctatctggctcaactacaatatgggattcataaaataatgacccctggttcgataatgacaggagccccaagctgccaggatgggtacttttgtggcaaggcagctcagagatcacccttcataaatttcaaattggttgcagatttgtgggtgagacttgccttgttattgtcttcctttaatttgcgactctattgcttctccatattgcctcaacctgtcaaatatctgataagattttcccatttaaatttgattcaggttaggattacctaccagtttaggaaggctccaatttattctaaatagatgtttctgagaataatatctctggaccttaaagtgtccctgagaccaattatactgtcagagtgattattttctaatcctcctccccttactgaggtttctggaccctacactccaatatgtacctgtgtttctaaactagactaatttaccattctctgttacccccttctcaatctgaccccaaacttccctctttcaggaagtctgctttgcttgatattacccacttttgaccacagagttttagattagtagaaacttagttatgaatgagatcttagagtccatttagtctaactttccacttgaggcagaaattgcctctagatgatctctgagtgatggtgattcttatcttcagtgacaaagtgctcatgattccatgagacagctaattttattgttggtcagatctaattgttagtaaattattttatgtaattgaaatctgactttgtctaatttaggcttgttgaccttagttcaaccctctagagtaatgcaaagctatacaatttcatttctacttgaagtccttcagctaattgagacagcagttattactatcacacagtctttttgccagtgtgttatactttttggttgatccatgtctccttattttttttctttctcttatgcttcatttacttttttatgcttattccacagttttagaggtgaaatctcttcattattttgtgtcccttaagaatttatgtccttgacatgtagaatatgttttaagttactcagtttttgcctttcttcaatcatgtattccctcaatatttattaagtacttttatttgtggcaggtgtatggtaggtgctagcaatgactaaggccaactccccaccctcaagaagcacttactgatgtgtcacactaacttttctcaagttattaattattactatagtcacatttatcagtggaataagatcagtttatgaacaaagaaaaccagaagactgggatattgagacattgatgctttcaaccagtgttatgcttgtttgtctggtggccattcctcacccctctctccacttgctactttttgtatattaaaagatatttggacctgaaaaagatggattttccgtagagactattgagatagcaaacacagaagcctgaggtcaaataaacttttgggctgagaatggaagtcttagctcaatgccatttcacttgttggcaattcaaaggtgttagttatacttctgccccatccagagggcaaatgttccctctgagttgacaatacagggaagcaggaaaatggaatgaaaatttcaaccaagtaacaagaagtagagaagtagaaggtcttttctgatggaataagactacagagccatgaaaaaccttgatttaggccccaaaagctatttggagaagaagtgagccttctgtaggggagcattgtaatccaagaacttcatgcaggtgactgtggtatggtgccgaggtcttcctacttgcctccttctcagatgctcactgtgtccttttcaactggtcctgaagagttctgtggtccagagtcatctcattggtctaaacattgtgtgcttgttccctgtcccctcctctgtgttagctgccctgttggcttggttatatctctgcacagggatagaagcagctttccatcccagaaaatcatggagttgttctcagacatttgcatttgacatctagagagccaagcagaaactatgaattgtgaaattgagggcatagaggcttacgagtaaaactgcgtacagccgtattcagcatgctcatatttgggtgttcctaagaaaattcctaaaagtcacagtcattgtgctcaggcagcttttgtttgaggaaggtccgtcatactcaggagcattagcagaacggtgccccagcatcatggtggcatggaaagccacttagataggcttgtgctgtctattcacagatcccaagggtcccatgttcttcctactgttgtcttttgctctgctagagggcagagcactctctacgtctgcttcactgctctgccttaagtcctgtctgctttaaggatcagctcaatgcctgtccatagtgactcatactccagtttgcaccctgcatttagaacagagccccttctcactttacccacccaactagagacatactctttaagggtggtatgttttgtaaggtcagggaatatgtcttgtcttaggcactgcacttggtggttaggtgtgggatgtgatgctctacttcaatctcctggacaatggcaccaagaggcaagggagaaggaagttcatgatgggtggaggttggataaaggataagatagagcttggtcttctgttgtaaagaagaccagaggttgtaataatcacgtcgccttcaatcacccattcactctatcaccatggccctatgggcagggctgttctcccttcttctgttttcattccccaggaaacctcttttgggccttgctttcccctctaaagccaaggtcatcagtgaagtttgttttaacctcatttcatctgtgaaaggggttggatgggtaaagtgagaaaaagaaggcagatgacaacattccatgtgatgtgttctggagccctgccccttcaaggaacttccagaatgtctagctcggtaacagaatatgtgctttataaatgtgtattgtttgataactgattaacatttgccaagccacataaaagcaagtgaaatgaataacaactcacttacctattttggggacaacttttaccattcaggacatagaaatagcctttctagtggaaagcccatgtgaccagaacttattgacctatggtagtgtataaattaaagttcctgattgggccgtctttaatattttccaggacagagattagagggaggtgctctgggctgctgataccttagtgatatctacccatgaaggaggagagagtgaaatccttagatatttagtatatctctgaatatgttaaatgtatattcagagctctctgaacttctcagtgtagtctgcaatggttaggtagtttactattttcaagaagtaaaattattagattttttttaaaaactgcttaaagactaacatcagttatctggaaacatacatggggtaccgtcttttccagtgatactttaaaaatgactatttaccaataatatcaagttttgttgagactatggagttcctggaacttactttgctggtgggagtgtatatttatacagcactttaaagagaattttcatgatatctattatgcacaccccatgaacccataattctacacctggatatacccaatagatttgaactccatctaaaaacaaaaacaaaagcatgtacaagaatgttcatatcagctttattcataacagcctcaaactggaaacaaccaaaatgttgtttccaacaacagtagaatggataaatacattgtatatcaacgccacagaatgttatacagaaaagataaagagcgcactattggcactctaatagtatagaagcatcttagaagattgcgaaaggaagccagacataagagaatacatattgtattctcccacttatatgaccaaacaaacctaatgtgtgggacagaggtcagaataatagctattcttgactggaagggggcatgagggagccttctgggtagctgtaaatgttctaaatcttggtctggtgattatattagtgtataacatatgcagaaattcacccagctgtacccttatgatttgtatactttgtgcaagttatgctttaatgaaaaagcaaagaaaaggaagagagattgctgaagtgtgatgctgagtaatttgccacagaccccagtgtcttctatatgtctgaaggttaacagataatattcttaaggttcttgcccctgaaacttcttgtgaattttagcatatttttcctgcttccaacttgctctggaaagaactggagtctgtgactcaggagtcctctgctatagtctctcagccccagttaccaactgtgtttacttacaggtcagttcttcaaggagtatatgaaatagaccttccagtcactcctctacctttgacccatggggtctggtgaacataaagtgaggtataagctatcaaggagtttttgaaaaacattaaaagggccacccaaatactaagaagtaagattgtacttgaacttgatgaaattgatggcagctactgattagaatcacataaggtgctgttgacaaagacaatgctgtgactttaaagaattgggcagtgatttatgaatcatcatggtacttggctcagggctctcagtggcagctgtgacatcagggtgtaggaacacatgaggtgacttgtgtgttgggaaattgtggtgattacagaagcagccactgccgggaggtcagcatcacatgcttagaatgatggttcttttccaggtgaagcccttggactactgtggccaagtgaacagtgccctgtttagacaacccaggcccatttctggcttttccaccaaataattatgtgacacaaggcaatctgttcgcttccctggaccttagttcctcctctgtaaaatgggggaaatgatgtcataagtccctctgagctctaacttcctccatgtcttccccacatagccagttctcactttttttccgtatgtgtattatatggtcagttttaaatctggaacagtcttcttttcatgtggctgttttttacaagtagatctttaagaagacaactcagctgccaagaatcatgttgtctcctaacaaacaatatccattattctggaatattgattatccatcatttcaacaacccagtatctctttccatcattagtgctgatgactgggtgctgcctgaattacacaaccactttcctatccctccagcctcctctaccctgttggagccccaggtggacatgtcttgatgagcaaagctgtgcattagtaatgcttagtttggggccacattttcctaaggtttgtgagggaagctcaatcatcacttcaagtgcccagagcctagaacccgagccggtgagaacactgatgggaggagaagaaacttagtgagagggagcctccatcactgggaagtgagcactgcagcaccgcacaacacatactcctggacttctttcctggcctgagcttttcaaggctgaatgaatgtgcaaagccaggaagaaaataccttactctcctctggtcagcctgggcagagatcttcttttacacacggcaggacttggggaaggaagaggaggatgatgaggccaggagaaggtgactttgttgtgtctgggaaggaaccagggccttgtaactcagagaattggggaaaagctttgtggcaccttcatttttctggctccttcatggctgttttggcagggatttttgccccgtctcacattccaagttctttcatgagagctttgtgggtcagaggcagggaactagaccagaccttaacctctgaagacacaaattctcccctggcagcccctgtctctttgggagttgttctggttcctcctgctggggcatttacactgttttctctgaagtcaaatccatcttcctctctgtcctctggaatttggtttctgaggcacttagtaggtgatagcatgactgactgcctcactgaccacttccagatgagggttactctcctcacagcacggccttgaggcagctcatgccagggatgctgcctgtgttccaactgtggatctgcattctgggaacagccaattgatctgatggtgcggggttactttttattttttaaatttaaaaattaaaaaaaatatatccttagtggtgattaaaacttcagaactgtttttgaatactaatttggtttttggaaacagcccaactccattcgggaaaatctggggaagagggaatcaaatctgggcaagctgggtgacagtattttagtttaaaaaacaaaacaacaaccttcctctctcccccacctcaaaaaaacacaacacaaggtttgtctattaagtaatgaaacagtttgcttgtttttaaatttagaacgacagtcgaggctgttttcagaagttcaaaaatgtttagtgtctgctagaataagcacagagccccggaggtagctaacaaggacagccctcatttctgtcttcaattcaggaggccacaggtcaggatctgtggcattgtggagggcccacccagggcactgcctgtgattgcagacccactcctgtgccttatggggagggaggcgctagaggaatctggggctattgccaagtcccctatcgttcacatgttcctggagaaggagtttggatactgacaaatcctgcatcagggagggctacctgagtccagagatctcatcctgagcctgtctgcttgcctggaaccacaggcaaaaagagtttcagggcagccggaataggacaacatgttcctagtataactaaaatggcctttatcaagttgctttaaagaggtgttctttgactgctgaaagaaatcatagatgacacaaacaaatggaaacacatcccatgctcatggatgggtagaatcaatattgtgaaaatgaccatactgccaaaagcaagctacaaattcaatgcaatccccatcaaaataccaccatcgttcctcacacagttagaaaaatcaattctaaaattcatttggaaccaaaaagagagcccatggagccaaagcaagactaagcaaaaagattaaatctggaggtatcacactacctgatttcaaactatactataaggctatagtcaccaaaacagcgtgatactggcataaaaataggcacatagaccaatggaacagaatagagaacccagaaataaacccaaatacttacaaccaactgatctttgacaaagcaaacaaaaacataaagtagggaaaggacacccttttcaacaaatggtgctggtataattgactacccacatgtagaagaatgaaactggatcctcatctctcaccttatacaaaaatcaactcaaggtggattaaagacttaagacctgaaactataaaaattctagaagacagcatttgaaaaacccttctagacattggcttaggcaaggatttcatagccgaaaacccaaaagcaaatgcaataaaaacaaagataaatatctgggacctaattaaactaaagagcttttgcatggcaaaaggaacagtcagcagagtaaacagacaacccactgagtgggagaaaatcttcacaatttatacatttgacaaaggactaatatccagaatctacaacggactcagacaaatcagtaagaaaaaaacaaacaattacatcaaaaagtgggttaaggacatgaatagacgattctcaaaagaagatacacaaatggccgacaaacatatgaaaaaatgctcaacatcactaatgatcagggaaatgcaaatcaaaaccatagtgcaataccaccttactcctgcaagaatggccataataagaaaacaaaaaaacagtagacattggcgtggatgcggtgatcagggaacacttctacactgctggtgtgaatgtaaactagtacagccactgtggaaaatagtgtggagattccttaaggaactaaaagtggaaccaccatttgatccagcaatgccactactgggtatctacccagaggaaaagaagtcattacttgaaaaagatacttgcacacgcatggttatagcagcacagttcacaattgcaaaattgtggaaccaacccaaatgcccatcaatcaatgagtggataaagaaaatgtggtatatacatatgatggaatactactcagccctaaaaaggaatgaattaacagcatttgcaatgacctggatgagattggagactattattctaagtgaagtaactcaggagtggaaaaccaagcatcgtgtgttctcactgatatgtgggagctaagctatgaggacacaaaggcataagaatgatacagtggactttggaggcttgtggggaagagtgggaggggggcaagggataaaagattatagatatggtgcagggtgtactgcttgggtgatgggtgcaccaggatctcacaaatcaccactaaagaacttacacatgtaaccaaataccacctgtaccccgataacttatggaaaataaaatttaaaaaataggtgttctttgaaagggtgtgggggtgttagaggtctggggtctgcactgtgagctgtcttatagggaaagtctggttccaagggacccagcctgtttttaaggacagcgaatcaagatgctgggattatggagatggctgctgaagagaactcttgccccaaactatgaacagtcatgaagttttctttcttggtggggaagggtccttgatgagggaccagtgtaggggacattctaaacacagcagcccagctgctcaactcagagtcaaccaggggcccattctggagaaagaagggaagtgatgaacactgggcatctgctatatactgggcatttccttatatcattttatgtaattctcaatagtccttcaagggactgttacattccccattctacagatgagaaaatggaggcacagatggtgcagctgcttgtcctcatctccttactgcaggatcccttctcacttgcctgcataccctgttacagtctttgcactcagtatattgcattgtgatgacttccccacacctagaaattctaatgaaattggtctgggatggggcccagactggtattattttaaaagctccccagcttattttaattgcagccagggctaagaactgatagtttagattatgggtttttcatttttttttttatatccccagggcctaagtcagtggaactcaaacttgagcacacatcagaataatctggaggacttgttaaaacacaagttgtttgccctaccttcagcgtttctgattcagcaggtctacagtgggcccaagaatttatacttctcacaagttcccaggtgatgctgatgctgctggtctggggaccttgctatgagagcccctgatcctttagaacgagaggaggcacttgttcattacatgctgactgaattttaccaaattgccaaggtcccccccccattgattggaatcaggatttgaatactggcctaccaggtagcaaataggctggctctaggggagcctgggtggtagagtgaggtgggcctgcctgtctacttaacctctgggaggagagtagagtttgttggcctttagggtctcctcacagggagaaacaataaccagtttcttgccaggaaacctagtggctgttaaaggcccagaaattttgggtagaggtttgaggcagccagaagatcctagaatcctaatccaggacacagattcctagtgcagagtgtgacctgggaaaagatggtcatggatgtgcatgtaccagagtgtttgttacaaagctggtgacactgctctttaaagttacttcttgttttcgcactacaggaaattatggaggcactagtgatggaaacagggcggagtgatgccagaggtggggagcgaggccctgagcagacccggatgattagggaacagggttgatggggcagagcagctgtgagagtttgggcacctggaaagaatgtttgaggccacagcaggaatggtgtgtttgggagaggaggaagaggctatgctgatgaatatagcagaggacatggggagtctggattctcattctggagggacgtgcttgttacctggacactggagtcgccggttttgctgaacaatgcatttaaaaaatgaaacctcaaaacaaatatttacttacgtgtacaacactgttctagatgctgtagggctgccaaaaactggttaatgagaaaaagcagagtgaggtaagtgttaagtgattgttgcaggtggcaagtccataagagtggggagaagagtccagttggctgtgtggctgggaaggctgtgagcctgctggtcctggcaggatgagtgagtgtgagatgtgctgtgtcaatggggtgagcaaaggtgtagggtggggctctaatgagggacagctcattatgggagcaatggagcatttgtgcagaggatgtaaggatgtggttgaaaaggggaaatgaatgaatgccaccttgtccttgtttgctgttccctctctctctccaagtgtgagggctgggactaacttgaggatgcaagcctcctgactagcagggctgctggaactgactacttcttaaaagagtttctccaaggagtccttacacgcaaattttatgttatttttaccctttccagaaatactggaggctggaggaagaggaggaaagctctctctccttttagaaatgggactactgaggtctagagaagggaaaaggctaaaaatggtgctctgggtgtgggtcggatgcagggagatggctgaaatggccatctgaatgtaatagtgtcctctgagggcaggggtgaagggcacagttttctctgaacagcattgggatatggatgcttgaccctaagaatcttctgtaaagtatgtgtttttgtggatctgggaggaagtatagagaacaagggaggtcagaacagccctagtcggagcttaaggccctggacattcccagggatccccagtggcccccagcaggctggtatctcaaggttcacagagcctgtcctgggtgccacatcctagcactgtggtttcaggcatctcccacaatttgtgccacttccaccaccctcctgcagctttctctttgcccctcactgccacctctgggctcagtgggagttgagcagctaatcagaactgcaaaatcctctctccctgctggatcaccattagacatcaatttagcatgtctttggagagacctactcttttccactcccccaactttgaagtcagttagctctgactaaaagagggggaggggaggctctctgtgctctactccaccagtggtatcacccaccagtatttataccaaagaggttctgttgccttgacaactttcttgcatgggttctggtgctcagaatatctgacaaatagcaatgcttcacactcaatgggcagagacagacaagcagatcaaagagcaaatctcaatgatcaatgccagggtcaaagatgaaaagagtgactgaggcaggatacaagaaagccactgaggccagaggattcactgaagttcttcccttctcccatattctctccctccacctttccttatgtattctcctcctcctttctgtggaattcccgggccttttggtcttcatagatcagtcatcagcatgaactagggggcctgtatggcagagtattcccctggaccactgaagggacatggtgagtacagagggggtaactcctaactatggctttggtcctcagagagctcccagcttgttggaggagaccatggtattcatctccatgacacttctgctggggggaaaaggaaggctattagtgtgagggagcccaaaagttgagatggtgttctctgatattgtttacatatgtatgtatcatggcgcatataatacagatgtgaggccacagaaaaagctcactgcaaagataaatggtgcaagagtggggaccggggagcatatgggaggacttgcagcaggaggctggggaagctagcccagggataaaagtccttttgtggtagagaagagctctcctctcaggttccatctatagggcccagatcctttcttttttctcttggttacatggtcctttgtgagaaccatatctccttggatgcaaaagaccagagtaatgaggaggcaaagggattctgatgttgacaacactctctttaagttgttctccagagaaaacatgctgaatgggtgggtgctcatgtgtcaaagtttgggtgtatatgttaagtaagtgaagcttccacagaaacagaacaaaatactacatcttttgtggcttcctatggcatgatcctcttgagtcacacttggattagtgttttaatgcattcatttctttattcctcctgcagtttattgtgtactagctatgtactaggccctgcacagtatagactcttctaaaccactactttctgctttgctgagaactgctgggcagcagtccctctcttgttagggacaaggagggtttgtacagagaggagagaggcagagccttagggcacagtgagagggaatgcaagagtggtcagatacatggtagaaaaaccagagcacctgggggttcccttgtcaagggttgcaaggaaggagagggcactacactcaaggattggagagtgagatagaactgtgggggattggatgtgaggagatcatggtcatctttgaaataacagtttcaggactgggttggtgcagaatgaaagcttaggtgagcaacaaggggggattttgtatcatctgaaagggcttcctggtttcagacctcctttctcctggtacaccttgatctctctaactctgccttcacgggagatagaagtggcttttctgttgcgctttgccgtgctctctggagaggtcctgccccctatctttcatattgtaccctaaagggcccatattgtcatatggtagttccaccagcagagttatctctcttgtgacttcttttatctgatgattaggactgatccccagtgaagctgtgaaacttgctttctaggtccctttgccagtccggtcaatcgttgactaacttcagtagcctacccaaatatggccaatgattccacctccagaatgcccctctcctcctctccaaagcattaaaaccctggctcccccaggcatctgataaatgaatacatactcttgtacttacggctggtaacaactcactaagttatgcctcacaggagaatgtgtagtttaaaagaaacatattaagctagagaaataaatctctaatggtagaatttcaactgccactgacaagcgaatagaagtgatattttaggggccatgagctgcatttatagagctcttctctgtctctgtcagaccttatcttgaggatggaattcagttcaaggtgccccagatggaacaagtgagattcttacccaggtctctctgaatccaaaatcttatcccctgtctctatagcaagatgctgggtgaggtctcctgtgattccctgcccatggcaaaggctagatgacccctcactagagcacagaaggaattcttgcctggacagggaagtggcttcaccctgtttgaaagcttcacttgctctactgatgggaataattaagtgttggccctgagagtccattcccattctccctgtgacttctttcaccagagcatacagtttccaactcccaaagcagcagccttgccctcccggggggggcacagggagtaggggagggctggtctcaccctgggtcatgggtgacttcacctccccttccccagcctcaggtttccttttcttgagtttatgattcatgattatttcatttggatatcttagaagaatcttaaaaatgcatagaatggaaataatctacctcattaccaccttctccgcaaattttttgttgggcttctctagttctgaatgtgataccatcatgttcttgccttgaagcttgggttaactttgattccgccttcttcagccccccagtcaccaggacttgtctgtttgtccttgaaatacccagggaaccggtccttcctggccacctccaatgccatccctaattcagactctcttcatcccatgcctaatagctccttccctggctttctgaaccctgcaggtttcttttacttcaactcctcttttcaccatgtctttcctcactggaacagctgatggttttcatagccctggtcgaagattagaatcctcactctgtcagccacaactccctagcctcgcccaaccccacttttttatactgtttcccaccagctctgtcttctaagcaaagtgatcttccttggagcatattttctgctttttctcatgtgggtgagatttttccttttccaaatgcccttacctctctcatcctctcctcacctgtcctccccctgaatcctttaaggctcagatccaaactccttcttccacagaatccccatttaaactgtactatgatttatttttgtacatctcatttggcactttttgtaggttttcactaattgttaattttcacattttatctccttggttgcaaattgtcttttccatagcacttggcacaatgaagggtgttggttagtgactgcctggttctcattctttctgcgttctcaccttcctttcagtcacagcctgtctttgccccaggaatctgcccttgttaatcctggctatttttcagcctgtcagtatctctgcctgtgttgcctcaaccagtgttccttgcacccctttttcctattaaatctcagcatctcagagaagcagtgtgggccagtgggaagtgctcaggctttggggctgggaggatctgggtttgaatcccagctctgctgtgtggttttgagcaagtcactctctgaggctttggccttttcaactctgaaaatggggaaactattctttatcattaggtaaaaatacataataggccctcaggaaacatttatctccctctcccctccattctcaattcctccttctccatgcagcccttcccaagtaccccaggtgatactcacctctgctcttactgagatcctgtggcatgtacagtgtcagagacatagggctaagctttgtttatgtctctcaacttagagagcggatgcctgaggtccagagatgtggagcgacttgccacaggcttccccaagcaggtaagtggctgagccaggtccagcactcagtcctgcgtttcaggcaggtgtctgtctctgtacccagccaacacatgggctccttcagcttgagggctgtctctatccccacagcatcctgcacaatgttgaatgaacatggagaaggtgcttaataaatacttgttggtcaactatgtgtgtgagtcctacttccctggtgggagtaaagattgttatgttcagcttttgtccctttttggtattcattgcaggcctggttacagtacctgaaggttaatttcagacctaagaaccagggtttttcagtggttcctggggctgtccctacagtattctgcctagctctggagagaatgattctgtggagtgtccatttgtgagcggctccgtggggagaggcctgtgtgtgtagcctcgatgcttgcttataccacttttcctcccactctgtactcctccagcctcccctctttccatctccaccccccacccactccctgcaccatgccgctgctctccctgctctaagaataaatcatcactgttgcatagcaacgagtttggtttcctttactcctccttctcctcctcctcccacaaaagtgcctcagtgctaaatttaaggtagtgtgtcaggggatgctatcaccccacaaatgcctctgaaccccagcattgtttccctatagctactagctttataaggacagaaactgtgatggcttttttttttcacttttctaccctcagcacctaatacagtttctagtactaggcacatagtaggtgttcagtgaaaatctattggatgattaatgaatgaatcattttattggaattcttgcagttaagaggtgcttctgggaaggggaaatgttattgcagactctgggattatccataattcacctctcttggctgggtgcctcccctcctttctttccgcagccaccaaaaaagctgatctagcaagaaaaggcacatatttcttcatatctcactgtcatgtggatggtggatgtgtttccctctctattttctggaaactggtggttcaggcaatccacatggtttattgagcccaatgggaagtaccagtctaatggggctttagggttgggaacagattgctctttttgatgacaggagtatgaggcttgttttctggggaagatggacgtctgtgagctttgaagtcacaaagtcctggatttgaatcccagctctgcaacttgcgagctgtgtggccctgggtgggtcccttaacttagttcatgggttgtaagaattgcatgaagaaaactactaatagagcctcacagagtgctaggaaacaagggtgcccaaatagtgtgtgtttctttttcccctttaaatggagagagagaaacataccagaaaatacctattaatgctagtgatggaatgccatctatacatagacaggcaggacaaacaaaggtaaaccaagtgaaatttaacaattttggtgtcctaaaagcttccaataaagactaaaaaggctctaatgtatatttgttcaataaataagactggcgtcaaattctgtttgaaagtggggcatatatcctaaataaataaattttaaaaaagccagttttcattttagaacaggataatctgaacaattggaagctattagatgggcagtaagggggggatctaaggagtgtctcttttggggccagagggagtgttctccttggacctaacatatgtaccttttttctttttctggcctgaaaaataagtgttggatttcacaactgactccctagctaccctatgttcatctccttccaaacattcccaaatagcatcccaaattgactcagttgtagcttcatggagtaggaagtccaggatccagagggagaatgacaagtccagctgctcctctgagatcctggaactagaggttggagaggaggctgggaaggggccactgttcagctaaaaatagcagcatcagcaactaaagagcagccagagatcagaacctggggcagccccaggcacgcattcccagcagagaagtctgagcttagctaaatttttccctgctccttaggaaggggtagtgggtactgcctgatcttctgtgtcatctgtgcatctgtgcctgcccacagtgggcagctagcatctccccttccaggtatgcacaccacttccttgtcattgtcaccatcatcctcgtcctcctcctcttcctcattgtcctccttctcctcttcctcgtcctcctcctcttcctcatcatcctcctcctcctattcctcatcctcctcctcttcctcgtcttccttctcctcctcttcctcatcctcctcctcttcctcatcctcctcctcttcctcatcctcttcctcttcctcatcctcctcctcttcctccttctggttgccatttctcatcctccccttccctcttgtctctctgcagcattaccacagcagcatccatttactagactttcataaacgagtcactttttacagtgttcttgggcctctgtcgtctggaagtctgtagtttgagatggcaccctggactgaaggcttccaggaaaacaatccaagcagccattaaataaacatgaaatagatgagatagagtgttcttactctgtagaagttgaggccagtggtatttgtggagccttctgggtgtgtgttcaagaaagcccaggagtttcctgcttgaaaaaggtgagggtggactaagtcagtgctttcctagggaccagtgtttgaggggaggagcaagcccttctcttatgggcaagaggatgcttcctggctagagcttaaggctggaccttgggaaaagatgcccagcagctggaggtgagggatctgaggagacagggttaaggccatgttcgcatttgctccagacctatcctcctccctttatcgatctactgatccagtgactccctcattcatctactcaacaaacatttaaggaactctgctacgtacctgtgtggatgggagagtgttctaaatcagtgagttttcaccctagccacacgttggaattgcctatggaacctgaaaaacgctgatgcccaagcttcaccccagatcaatgacattaaaaagtctctgggtctgagatgtaggagtgagtattgtatcagagttccctgagtgatttcattgttctgtcagggtagacagccactggtctcagtgacatctgaggcttcttcctgtggcagtgccactcactgcccctcttcttctgagtgacatgaccaaaggtgtgacttgcagtcactgcagcagctgctactctgtgcccacttcacataaacgtctactgagcagctagtatgtgcccagcattagagagacacagagatgaggctaacagtatccccaggaagtaaattaatgtaaccactccatttccttaaatgtttatctggtgagccagaagccagcttttctgatgaatgggattttctgagatttgtcctgtcttctccctctgtggaagaaactgtgactatatctggtacgtttcagttaaatggagatgaagcaggtggtaaaaaagacacacacagaaatagatggaatgcaggcaaacagggagggatgttgaagggacaaagtgttctctttaggcaggttttcaagggtgcaccatcaaggtgaaatcatggaaaggtaaaagtaaataatatgcctgtttgagtgcttagattatcagcaggaattgggccctcatgaggcatctggttctgagcacagtgggcatgaccctggcactcagagagcatacaatcctccttggcaattaaaaccaatatccaaaacacagagatcttaagccctcagttgtgtttcactgaaagtaaggttcctacaggcttggagaagggaggtaatggagaagtgctccctaaagtgtggtccatggaactgctctgccaaccatttgttgtcagtcagtaatgaggagcacagaaatagaaaggaagcatttagaaactttatagcaatttgccagagtaattttatgtctgttgaatctaaaaattaaaaaattggaacttttgtttttaaaattgtactttgctggtaattcattttcattatagtttactaaagtactagtctataacagattagaataaaagcagaaaaaaaaatcaaactgagccttcactgcaaatggctcgaggagaagcactggactggaaatttgagacatcctggcaggctagagaggtactagaaggtggggaaagggcagatgttctatcggatgttaaaaagggagtaagggccaggctcagtgtctcacgcctgtaatcccagcactttgggaggccgaggcaggcagatcacttgaggccaggagtttgagaccagtctggtcaacatggtgaaaccccatctctactaaaaatacaaaaattagccagtatggtggtgcatgcctgtaatcctagctactcaggaggctgaggcaggagaatcgcttgcgcctgggaggcagaggttgcagtgagctgagattgcacctctgcactccagcctgggcaatagagcgactctgtctcaaaaaaaaaaaaaaaaaaaagaaaagaaaaaaaaagaggtgggggttagtaaatcctggaaacctagaacttatccatgagtgaggctctaaaacaacaaatatttattgagttatttgtggatgctggaactataccatgtgctttatataaattattttattgtctccttttacaaaactatgtgagataatagcgctcatcaccatctttgttttgcgaggcttgaaaagagcaagtaaggtccccaggttatcacagctagtgagtggtgggcctacattttaaagccaggtgtgttggactccaaagcctaatggtttataactccccaccccatgcagcccctccaggtgagagggagcacaggcaataggctctgcccatccagacattccagaatacgaatgaggagaaggccctgcagattcagatcatggagcatcttctataagcaagtgcttatggaagatactctgcctcctagggagagacagagtgtggacttttatctgacagttcttgctgtctgtttgcctccgtgttatttcaagaagtatttgagtaggtggacctatcctagtttgggccttttattaggttttgaattgtcctgtcagtagcttgtgttagtggcatctccatccattagaaaaaaattattttgaaataattataccttcataggaagttgcaaagaaacatacatggaagtcctgtgtgcccttcatccagcatcccccactgttaacatcttgcacaactgtagtacaatatcagactaggaaataatccacagactcatccatccagtttttctcccatattctgagaatcacattttaaaagaagcatcactaggccaaagtgtatctggaagagggagagggtggttggtctagaagccaggtcatatccagaaattctaagggactgttgtgagctttttgcatatagatgctgtatgttatttacatgtcctgtcttagcacctaaaacagtgtgaggcacacagttgatcctcagatgttttttggattgaatgtttgattcagagcgtaaaacctgtgtacacacataatgggtgccttccgtgttgtggggcctttagtgaggaagaagggtgagatttgtctgtcccctattgctctagaatgcagagctgggattaatgaaagtgggaaggatggaacaagaaacatcccacccagatgtatagaaggacttgaccaacaatgggaacaatgcagcagggatgtagtcggctcccctctactggttgtgtttagtcagtagcaggccatcaggggttcagtgggatgattaatgcattttttgtttttagtactagatcagatggctttaatggaaatctctttcagtttcttgtttctgagattctaagaacatgtgcttatggacagaaataggataactgggaaggggcaccagtttatgagaggaatcttcatggagtttgaggaaacagcaaaactttctcatggaagatcacctgtagattttgaaaacactgtatttgctttttaaaaggaagatcataggcagccaggtatgaaaccccttctcttagtgtttctgtgtaacctgtggaatttgcccaggggaacatctagagttaacctggaaatcagatgcttttctttcaggcagcatttggcaacatcaaaacatcagttctagagaatattgtgggtgctagagtctgactataggtgacatgtttttgtcatgttaatcaattattgaaattaaggagaagattattgcaatttctattccaggaaatgaagcatgcgctgagttaatcagattactttcaggtgaaaaaggaaaaaaaaaataggtaaaggttcttaaattaggccacctgagaaggttattatatattcatatatgattacctggaaggtatgaatttaaatgatttatgtttttatttcattctggctagcaaggaagatagaaactattcctttcatgtgttttaaaagctcacagaaaatccatcattttttagttggggagaagagaaaggaacaaaaatgtatttactgcctactatatgccaataactttatattattattatgttaattttcacaataattctgatgggtatattttatcattattattttatgactaaaaaaactgaaactcagagcagataagtgttctggggcacacattgagtgaaaaatagagctgggactgaaagccaggtctggcagactccaaagccagtgctctttatgctgtttactattggcggcatgcaaccctagcagaatccaaactgactatgttcatgaatggatttcagaacttgtatgtctcataaccacaggtgtcagttccctgtctgtagcaaagtctgcccagatgagtctaccattgctgatgaccttttgtagtagagtcagactcaggcattgaaaccattgctacaagtaggagtcttggcacctacctatctccctgtaccccccagtgcctccacaatgcatgatcttgaaggtgaatgctgtcctttcctttgactgtggcacagcttccagcttgcctgctgcccagtgtctaataatcctagcttaatttttttccaagttttggaagtgggatctcattctcttaagtggcttggagagaagccaagagaccccatggtacaaaggacagagcacatgacaaatatgttctatccatgctatggaacttgccagccatgtcgttttaaagagtctcttagttgtctgagtctcagttctttcaccaatgaaaaggggataatactaaccttctctattttcattgtaaggtgagtatgagattcagatgctattggtatctaggaaactctgaaaataataaggcattatacaaatgtaagagaaccatctgtcctctgcaaaagctttcctccagaagaggtgaaagccaatacacacggcagagtagggaaacatcagcttttactagccagccgggttccgttttgctagaagtagacttggtctctgtggcctcctcttttccctgaatagcatagctgtgtttcttggcttggcttattgaaataattgctcccaatcttccctttccaatgaatgccaagctgttagacctgaactacagccactggctgaagccttccaaagatcctgattgggtggactgtgtcttgctcagcttaatttgcttgctggttatgtaaatattagggttgttaatcttcattagagggtgttagccaagaaaaattgtatttttataaacctgtatattaacatggggaaaaaagtaaaagtaaaccaaacaaaattgaacaactttgatgccctaaaagcttccaatgaaaactaaaaagccccttatgtgtatttgttcaacaaataagaccatggcttcaaattatttttgaaagtgggacatagatactaaataaattaaaaagcaaattttctttttttttcttaaggaatgttcaagttttttaaattattattatactttaagttctagggtacatgtgcacaacgtgcaggtttgttacatatgtatacatgtgccatgctggtgtgctgcacccattaactcgtcatttacattaggtatatctcctaatgctatccctcctccccaccccacaacaaattctcattttgaagagaataatcgggataattagaagctatccattttgctgtcatttatagatttgagtttgcaaagcagttttcatggattttttattttcctacatggactttattccttaaatgtagtttgtgtttatattttcatgttataaacttttcactgaagtatagcaagtgtacagaagagtgcacaaattctaagtgtacagctccacggatttttacccagtgaacacacttgagtaatcagcacacagatcaataacattatgagcaccctagaacattagcccctgcagggtccctttctgttgactagctcctcctctcaagggtaatctctgtggcaactcccagcatcatagattagtttgcctgttttgaaacttggtatatgtagaatcctaaaatacacactgttttgtgtctgtcctcttttgttcaatgttatgtatgtgagattaatccatgttgtgtatagcaatttatttctatattgtataaatatgccacaatttatccatcttactgtacaaggtatttgggttgtttccagcttggtgctattatgaataaagccgctatggatactctcgtacatatctattgacgaatatatacacccagttttgtggagtatatacctaaggggaaataccaaggaatggggtatgagtatgtttagctttaataaacactgccaaaaagttttccaaagcagttataatgatttatatcttcaccagcagatagaacacttcccattgtttcatacctttgccaatatttggtattatttgtcttttccattttggcttttctgctaggtatgtggtagtgtcacattgtgggcgttatgtttttgttttttgcatttccttgatggctaatgaagtctagaacattttcatatgtttattcgccatttggatatcctcttttgtaaggtgaatcttcatgtcttttgcctcatctttgctattgaattatctgcctttttcttattgagttgtaagagttctttatgcattctgaatatgagtcctttgtggaatatatgtattatgaatattttcttccagtctgtgtcttgtctctttacactccttatgatgcattttcatgaaatgaacatatgttattaactttattgtggtccagtttattattttttcttttatatttagtactttttgtgtcctgtttaagaaatttttgtctactgtaaatatttcctactgaaagctttattgttttacttctcacatttggatcagtaattcatttggaaatgcttttagtgtacggtgagaaagagaggttattattactattttgtattcaatttgagagcaggtactgtttattaactgaccagcttagaaaaataatcatggtagacaccttagttcattctaataagcctgttgatctggtcctccctgttgccagcatctccaccttctacaaaatggatggtctttttcttcattctgtctcatggagaagataatttaaagggccacaggaagttatttgcttctttgaagcgttttccaacattatagatctcatgaatcagatccttcctgcagatgatgcaagagatcgaacaatcaaagtgttatctgtcaaagcaattcgcttcttattgattttgccataaccacgcttgtagattagttcatttactgacttcagatttgggtacccctatgcaatatatggttctacagtcctcagcatattaattgaagtcttgttaagcttcacaaaggttccattgaagatttgacgaaggcgaagaagctgcaacacctttcggacctttgggctcacactattgatacctctgatcctgatgacaaatgccaatttgggttctgcaggtacatagaagttgccagcttttcttgccatcctggccattcgaatttcagttctgtacatctgcctatattccttgttacagtgcttttctttttctttttctttttcttttcttttcttttcttttcttttctttctttctttctttcttttttttttttttttttgagacagagcctctctctgttgcccaggctggagtgcagtggtgcaatcgaggctcactgcaacctctgctgcccgggttcaagcgattctcctgcctcagcatcctgagtagctgggattacaggctcctgctactgtggctggctaatttttgtagtttttgtttgtttgtttgtttgtttttcattgagacggggtttcaccatcttggccaagcttgtcttgaactcctgacctcgtgatccacccgcctcggcctctcaaagtgctgggattacaagtgtgagccactgcacctggctgtgctttgctttttcatagataagcttcctccttgccttttgaagcacctttgtgcaaacttctttctcaggtgcttgatcttcagctctgtgaaattccttcactttttcttaaaggtttctggcacagcaggaaccttcttctttttttaattttttttaattcttttttaatttttaaattttttaattttaatttttatttttttattattattatactttaagttttagggtacatgtgcacaatgtgccggttagttacatatgtacacatgtgccatgctggtgtgctgcacccattaactcatcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttcgttttttgtccttgcgatagtttactgagaatgatgatttccaatttcatccatgtccctacaaaggacatgaactcatcattttttatggctgcatagtattccatggtgtatatgtgccacattttcttaatccagtctgtcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttcaacaatggttgaactagtttacagtcccaccaacagtgtaaaagtgttcctatttctccacatcctctccagcacctgttgtttcctgactttttaatgattgccattctaactggtgtgagatgttatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaacttgtttgagttcattgtagattctggatatttgccctttgtcagatgagtaggttgcaaaaattttctcttcattttgtaggttgcctgttcactctgatggtagtttcttttgctgtgcagaagctctttagtttaattagatcccatttgtcaattttggcttttgttgccattgcttttggtgttttagacattccctttgaaaattggcacaagacagggatgccctctctcaccacttctattcaacatagtgttggaagttctggccagggcaattaggcaggagaaggaaataaagggtattcaattacaaaaacaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacacgaataacagacaaacagagagccaaatcatgagtgaactcccattcacaattgcttcaaagagaataaaatacttaggaatccaacttacaagggacttgaaggacctcttcaaggagaactacaaatcactgctcaatgaaataaaagaggatacaagcaaatggaagaacattccatgctcatgggtaggaagaatcaatatcgtgaaaatggccatactgcccaaggtaatttatagattcaatgccatcccatcaagctaccaatgactttcttcacagaattggaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagacgtcagaaataacgccacatatatacaactatctgacctttgacaaacttgagaaaaacaagcaatggggaaaggattccctatttaataaatggtgctgggaaaactggctagccatatgtagaaagctgaaactggatcccttccttacaccttatacaaaaattaattcaagatggattaaagacttaaaccttggacctaaaaccataaaaaccctagaagaaaacctggccattaccattcaggacataggcatgggcaaggacttcatgtctaaaacaccaaaggaaccttcttcttcttctcttctgcaccctccatggttccagccagaaaaaagagattttttttctcctgttttgtcatcagtagacttgaagacatttattgaaaataccattctttcctcacagcatcacaatgtcacctttgtcttaaatcagaggtgccaccaagtagttgatactaccttgagtttgattgtactaagtaagtggcttatctcttggcacaggcaggggtgactaagaaaggccaggacaggatcagaggtctagaacatttccagatccactgccccacagactaggtttaaatatccttctccaagtaaaataactttaatagaatcatagtatgaacacacagacagttcacaaacaagacagttaagaaaccatcctctccattagaagatggatatggagtggaaccatatgaaatggaatttaaagaaatgcaatacctactttcaggttaaattcagtttttcacaagattcaactgaaaatgattattactttgtctaataccagttctcacaataagggaaaggcttttctggaaacaggcttggctcatgcccatttcttggggttcatccatcacatctccctcagctgagtgcagaattagacacacagagcctttaccttcttgcttattttaattactctgtgaagggccttttgtttgtgtccagccgcttctggcaacctgaaatctttcaggatttctaagattcatctgggtctgggatgctgataagacagggtctccttagatagatggacacccatccaagggccccatccagcttaaactatggagaacatcaactctctggccaagccctcattcatccagagaatacagcttccttccatcagccagattcagggtggtatatgaagtggaatccctcctcttaggggacttggacctggtctaggcacctttaagttcagggagtttccctccacctctgcttctctctcctggggctgacccgaaagtcttggctgccataaatgagaaacattgttcagcaaacaaacctcattggagcaacagcttcttttgtaagtttccatttggtgaacaagtgcagttgaataccttctgtatattagcactcaacatctattcccagtccttgggatacttagtttacctctaatagtctctacttaaacttggggcctgacaaactttattaatgcttgatcacctgacctcaagtcttgctcattcctgttccccgccatgttagctgagtattttgtaatgaatctcatctgtctgctgtgtattatgccccactttgaacctgtgttttgacttgagtgaatccatgtcctattaaccagcaagactccaacttagccgaagtcctaagttcttaagtatcttgagatgcttcgctgctgccccaggatctgccattgagctcaggacaaagcagtgcacttgtcaagagagaattaatctttttcgcataatgccatccatgtgttggggtcctgtgttttccctgtgcccaatgacaaaagataaaacaatgacatggagttaggactgtggcataatgtcccaattgtcatgccttattttcatcaggaaagagtcccagtcactacaagcctttgccaccctagacgttgcataattttgattttgttcacccatttgctctatatgtacacagaatggctattttaggctctttaatgtctgttcttttaaaatagctttttaaagagactcttctgttttgtgtttatgtttcttaatctctgcacatttaaaaaccattgtatataatagagtcacagactttcagaacccagagatattagatgccattagttcagtcttttcatgactacataatattgtgagatttatctctctagagatatttttaaacttctgttataatcacaggaagtcagagctggaagacaactaaggactgtgctaggccagcaatgtcattctacagacaaggaccctgaggaggcaagtgactggaccacacaggcagtggtggaatagggtcctgaatctccagaccctcagtctggggctctttgttcgtgtagacagggctgcttctcacttccaatttcacttcctaattgtaacccaaagacagctaggagtttgtcgtggaatctgtgaatgtgcttgttatgaaacaccaatcactgccaggatttaaggtaacatagaaatacccgaaatgtcttttgggcaagagccatgaatcccaatgggagtaggctgggataagtagttatgttaataaaacttttccacatcaaaagtgtgagtcagattcaatgtataaatacctttaagaagttacacgcagagggagtttagttttagtacaaatagatcatttgtttgcatccctttccgaaataaggggggtagaagttatgtctttcaagttacactgatcactaaaaaaaggaaaaccatctgcaggagggtccttttccttgtggactgctgtcctgtgtggtatttctgataaagcttgagtttccagtgcagcagaggagaagaggagagtgtgtcttttcttcccttttgtcttaactgcattcagaaaattccacctctgcccctttcccctgcgaatgcccctggtcccagctccttcctgagtcctgttgctccaggtgcagtggctgtgggtctgggacctgtgggaacctcctgtgatggagtacagagcactgttaaggagaaaggaaacatcagagtcagctcttcttctgctcctcagggctccccttttcctgcccatctttctcctaggatagactggtctacgcagagaggctcacaggtgtgccttgtaaacttcagaaattattctacccgtcacactcagggtttgtttctgcctgctttgtgtcacctccaccccaccctctgctcctgaagcagggatgtttgtggctgaatgaggagggtggagtagatgggagtgtgtttacagcctcctctgggcttctgcctggtgactagaaggacctagatgggaacattgtggaagagatagcccacttctcccaggaagctcccagtctactgaggagatgataattgcttatctgatggcctctggtataaagtgatgcctgagctgagcgtttcttcattacctctcagatgccagcaccagtcctaggctagtgcatcagtagaagccggatctgagctgagatggtgattctgtcctctctggagaggccattgtccccaagaggcattcatgtggtgatttgcaaaacactgttgagtttctctttgcctgtttggggatttttatgcaaagggatctccattcctagaattcactgaaagcaatccctgacatgccctctgcaactcatcatgttaatgggaaagaagggctggaggccagccagggtaccctcctccccccaccacccgccaagccatgtcaggatggctatattgattgcagagtctgacggaagattacggcaatggatggggattcacttggcttttgcaaggccactgacagtggagaaataaagctctggctctggagcctgtcttcttaactgggcttccatccaggtcttccttgccatccccctactccccctagtccatgatgcacacccaaccagatctggcttccctgaacacctcttagtcaaactccccagttgcttagaaccccttaacgggtcctgttggcctggactcagggccctataggatcaggtatacatctacaaacaattgcctttacaaccttatcactgataaagcctgccctctgcagtgaaacccaccatctagtcagatggggtcttctcatagtcccctaaaaattccaggcttatttgtacctctatgcctttccccagatttttccccatgtcttctgagctcacctccctccatctgctcaaattcagttcctccttgagtacttggcttatgccacacctccctaacccttggcccacatggctttttcttttctttctttcgtttttgtttgtttgtttttgagacagggtcttagtttgtcactcaagctggagtgcagtggtgcaatctcagatcaccacagctttgagcttctgggctcaagtgaccctcctacctcagccccccaagtagctgggactataagcatgtgccaccacgcctgacccattttttgtattttttgtagagatggggttttgccctgttgccaaggctggtcttgaactcatgagctccagtgatccactagccttggcctcccaaagtgctgggattacaggcatgagccactgcacctggctggctttttttttttttttttaaactttctatctcttttaaagttaactggttacattttgccttctctgctcctctagctgtgcagtagcccatttctctgatgcgtaatacctgagggtaggaactgttagaccctccagtccagggcaaaatgtgagatgaacacatgctatttcttgggtaaatggggagagatgaatgcttgaaataatgaactctctctggacaatttagcatcatttccttcttaatccggtgttcatatacccgttgtaaagtgaggactagaggtactgatgggtatggggggagatggaagcaggattctcagaagggtttccagcatagcagtgatgatgagcaggattgagatggagcaggtgctagatgaaaaaacgaaaacgaaacccaaagaaaataagaaattgaatttgacataccttggtgaaggaaggtgggtgtactgagttgaataaatgtcccttgaaagttcatatctatctgaaatcttagaatgtgaccttacttggaaatagggtctttgcagatataattagttaagatgaagtcatactagattagggtggaccctaaatccaatgacgggtgttcttgtaagaggaacagaggatacacagaaaagcagaccatgtcttccatgccggcctggatggaggggcccatcaagcactcagggcagcctcaggatgatgggaagccatgggccaagccatccctgcaatgtgcaggagggagaaatcacatcagatgggatctcttgaatgttcacgtttttatgaagaaggaatctggttagaatgatcaggaataaaagaggtctgtgcagagagaagggtgatggggagtgtactgtggtgcttttgtgaaaagtggatgggatgtgggtttgcttttatgtgagtgaaaagagaagagaaggaaaggaagtgtgaaatgacccaattggttttttgcaatgaatgatgtgtaagaaaatggtcttttttttttctgggccatcaggcagctctgactatctgtcagatggagtcacatcaggcagagggtggggtaagagacagcctggcctttggaggatttccttaggtaccactccaacaccttctttctcctccttggtgtcggaggtggtgagggataatgggatgcacactgggagccttctctggatccctgcatggtcagtgccctgtctgagcaagtctgtccccttcttggattcttggtcttctcccatgtacagaaggcttacaaagtttatgtgagcattgaggaaaaatattttgtaaaccttaaaatgctgtataatattgtatcctgtagttctccaaggactgagaaggaagatagggggagtcttaatcctttggggtttgagggaggctcacatactgtgtgaaaagtaatgaaggtttcagtttgagatgatgaagttctagagatggctggtggtgatggttgcacaacaatgtgaaaatgtgaatggactgaatgccactgaactgtacacttaaacatggattaaatggtcaataatatatgctatctattttaccatgatagaaaagtcatacctccatccctcccccaaaaaagtaatgtacatacaggacaaagctgatatgtgagtaaatttgccactccagatatttacagagcagttattaacattttgtggtgaatgcttgtatttgcaatcattgcgaggaattaggactggttaccaggactcaacacaatatattattgttaatgcttttggatggctctagaaattcttttgggagggagtaaattatgtcacaataatggaaacagaagtgaactataagctgaacttaataacatgatctgagatcgcttctccccctctacccctgccttcaaggttgttctcctgccttagcactactttttctttgtttctcaatttactccttatcccagtaggtcaaggtgaaaacagatttgcatctatagtacagaaacatgtgaatcttctgtggcctcctgtatgttactaaaaatgtctcgtgttattatggactctgtcctgtgggccagactttgctcccagaaagaagcaagaactatttgcatatctcccagatcattcattctccaggcctgtgggcatccacatcaaagccttataggatcacccccaattgtctccttcctctagctccaaggtgtttttgaagatcagagccataagtatgattactgcttgagggtctctgcatttctgaggagtctcccataggctgaaggcccagaaagtaactcagaaaggggttgaaagatagataccttttggattgagaaattgttttacttcatcacaaaataaagtacttacagtttggggtttaaatactgggacttgtattgtacctcctctaaatcatcccagaaaatgaagcagagaacaatgttcaatgtagaactgcccatggtgccagatgattttgagtcacatacagagccaggtacagctctcaaatgttatgtctacttgtgtgacaggcagccagtttcctaagagggggttgggggcaggaaaaattcagtgccttcattgtgggctgcttcttgttgaattttgctccacaggttagaagacaggtcccagtcttcctaatgaggcattgaaagtctaggtggaatagatgcttgctggagcctgtggatattataaaagaaagagctcactgccttaatgtggtcaggagaggcaggagtgagagccagtgtgaaggtgtgggagttggaaggaacttggaactcaacttcttttggcccctcaacttgagattcacaaagaaaaaaagcaatgtctcctcgctgaaaggtaagagtttaaaatttatctgaactcggaatattatagtttgttttggctccagtggcatgtttccataatgtatttaaatcacaaatccctgctctgaggcaaagtcaaaacacctggtcttagtcctgaggtgaggccctcagagctggaatagtgctttgccctgtacaggggccattatccgatttatatacaatgcagaagattgtctagaacctagagaagcactaactacagtcttatccttttcctccttagcaaaatggaagctcctccttgcacagtgcagccccttcctcactgtaggttattccaagtgagaagagtaaacatgacttctaaatgccatctaacgatatatgcatatctaaaggagacaaggatgactgaatgcatcttcatgtgtaggaagtgaagtgtctgttgacattaagtacttcttcatgagtgagaggaggcccatgatggagatgacaccagtacctccttctagcactctgaattcccaatgtttactactgctgtctctgaaactgcagcatcctcaccaggaccacacagggaacaaaggcaagacacctgaaatccctttagccatattcacaacacttacttcatagataagatgatgtttgaaatatgagaaggattttttttttaaaagagcactctattctcttggtatcctagtatgagtgcctgaaagtgcacattggctagaaggtttcatgtgagcatcagccccagggtccagaagacactcttggcaagcctggagagtgagtatgttgaacaggcaatggaagcatccatgaaaggcaggcaactgcgcacgactttccaacagatggctggtcagttgcacagagggaaggagccatggattccatgataatgacacttgtgccagcttttgtgtttccagaagttttgaagatataagggaaccaccacatgtagagtatgtgaagtcttacagagacgaggtcctaaggtatttattttgacaaatcacgttgcaagtaatgtgaaagcagtttgaagaaaaaatgtccccatctaatgctgcattatggcatgcatttctttagcctaaatctgtcagtgacatgaaaatacatgttttgctggacacataataggttgaacacataataggttctaacatggatctgcataaagaagaaagaagaaaggctataaaggtagaagaataaatgtataaatattacaacaggacactgagctgagtggctctttaccatagaccttgctcatagttctcactacaggcttgctctgagccaacttccaagttctctccttctccttccaaacttccctgtatgtcatcttgctcctgggccacctgactgatgtttaatgcctggatatttgctttcacctctgcatgaccaagccttggccaagtcactgttgactcagttgcaacatctgtcccctgctgagggctgttgtagctttcatagctcacagtccagcttgaatctaaccttttctgtggtcattcagagtagcaagaagcattgtgttttggatttactgcagaactcacacacttaactgtacacagtcagtttttatagctatcactgcatccagattggacagtgaccttggctgagacatcctttacctctgtttcagattaatttaggcggcatataaaatctctgtgcactgccaggggaaagtaaagacttcatgaagaaatggagaagagccgaatagttgaccattgttgctgtataaatcttggatccagggctaaaaggtggcagtataaatgcagatggtgctgctgccatattttcctggcacacctttaagcagcacatttcaagccttcagggttggaatggcatttccaaatatagactcaaaaaatcctcagatgtttgattctagaatagagctgggaattctgtcctgcaaatgccttctgcagcatgggagcaaacccactcttctgtgtctgttgcttcaaactctctattttctggaaactggagaaagatgtgggtctacattttgaaatatatgccttgaacaagaattatgcacctatagaaaacttgtcatacattgaataaactctcagtttacagaaatctatggaaatatcaaaataaaacatcagaaggagcagtaactatagaggttattaactaaggggataacctgaaaaataaagttatatttgctaaaaactgtatttgattagtttggacttcttttttcctatccctttcctgttttatatttatattttatttcttctaaaattaagtgatctttcactatctaattaatattgtagaaaatgtccaagtctagacattaggacggcttttgttatttaagtcacatgcaagaagcagcatggttttgtggagagagctctacctttggagtccagctctaccttcggtgctaaccccaggcatctttgtcccgatcatagtacccctctgggcctctccttatatttgtaaaatgaggggggctctctgcagtatccttctggctataaaatctatcagctctcattgctgaaggtttcttctgttcagagtttctaggtttctcgtaaactgaggagccagaggtcaggaggaatggaaacttgttattccttttgtaacattgttcagagttttaaatgaaaacacaagtaattaatttgtcatcactgcttgaacatattatactttactgaattataaaatataatctttagaaaaacaaatttgttatgagaaataaatgttgctgcttgtctaaaattttttagggcccttcaaattattgcctacagtaccacttattagccctggctgtgcattagcatctcttagaaagcttttcaatatgccagtgtctgccctcccaccctcagatgtttttatctaatttgtctgttgtggggcctgggtaccaatatttttaagagacaagattgagaacaaattacgttcaattaccaaggctgatgtatgcatggttcccatgcatggcttgtacctatccacctccatagcaaccacatgtggtcccctccaacatgtcgtcatgtttcacacatgtcatttcacactgctccttctttgcgtcttctgttgtagcctggaatgccatgccctaagaggcttagactttctcgagcccctccctacagtatagatttctttattagcatagctcctgtactttgtaatggcctgccttgcactcattcttcctgtattgtaaatattttatccaccattgtatatatttatattcatacattggatcatgtctcttgggcttaatgcccaccccttccaagtgctttcgcactgtacctacctcggcctgtaaggcctcacatgatctctttctcatgtgctctccctgaaccatggcctctttctcaaacctctcttcctaccacttcctgcttgttcacttcacttcagccttacaagcctcctgaccctcaaacataccatgcttgtcctcatctcagggcctttgcacaagtggctcctctgcctggggtgtcttcttcccccgctcatcctcccatctgcctgctccccagcattcaggccctccctcaaatgccatctcctcaaagtggcctttcttaaccaccctagctagagtagcctgtcccccactctaccatcccagcgtcacaccccatcccactacttctatgttctttgtgggacttgtattatctcaagta

SEQ ID NO: 173 - DNA, 14639 bp, Homo sapiens
agggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaa

SEQ ID NO: 174 - DNA, 9867 bp, Homo sapiens
gtgcgggtttcggttggaggactcgttggggaggtggcctgcgcttgtagagactgcatccccgagacgatggcggagggagataatcgcagcaccaacctgctggtgagtcctggctgcctgtcccccgggagccgagcgaggcctccagacgtccgtgggctcaaacaccgcggcctcgtccctgtcacccgccgcgggcccggcccttctctccctgggcaggcgacgatgcctggccctcgggcttcttgggtgactcctgggtgtcgaacccttacctttcctggggacggtgcgcgacggggcgaggagggcgcgtgattcatcaccgcgagtaggagtcgaggaggaagtgggaggcagaggggctgcgacactagcctggggtgcgggtgggggcagaaggcctcctggggcctgtccagcgctttcgcggctcaggccccagccgtattcggctttccccgtctttgatcttaacctggatgtgcctgccttcttttccccctaaaacttggacaagggtggagggtcaaagggctactgcccagaatttatcttagagctggtacaacttaaaacgacagggaggctgcgagctcaccgtggggaaccgggagcggggtccagctgaacagacaatgggatgtcttggcgtttgtctggaatttggaagtctggcgggggtggggtcacaggactactggaaacagctttagagtaataagcagggatccgaaggaactgcagtgagatggtatcataggcggacacatttttatttgttatgaatttaagcgcaccttgtgggcaaaaaacaagagaaatatccttgcatattctcagttgcccttccctggtgactgtaggtcacataccagcaatgaaaaacggaaccaaagaatttacttaggggcttttgaacttccaagaccccagacgctggccaatgacgtgacttcagggcagttttgattgtgcgtgattttatatttgcttttagaaatgcatggtttgttcctttaaacacacgctccttctagcatagttagttctcagcgtggatctttttaagaggattaattgaagcacagagaagtagctcaagccctgttgaaatgacaaatcctgggctagagctcctgcttcccaactctccttccagcagagcaatataactctaaggaaagcaacgcctttggtcgtggatttcttggatgcagatcagttaacctctgtatctgtttcctccttggtaaaatggggacagtaataacacctttttttaagggttgttaggaagattaattgaagtataaatatgaatgctcagcagagtgcccacacatagtagtctctttcactagtattaagcatggaatataaagtcagaaatattgagatcacactagtgctcagcgtggcacagatagcgagcgtctttgttaagattaagtgccttgttctgtcatttgcatgatttccagtgaatgacttttacaaagagacaaggtctcagcccaggctggtcccgatctcctgggctcaagcaatcccccccgacccgccaagtgctgggtttacaggcgtgatccactgcatccagcctgataacatagagacacttgagtttcttattctaaatttttcttcctttaccaaaaccagctttaagggcttttgccacattagctcatcctagaggcccactttcggctgttcagagtcagagaaatttgaagtataatcaaaatgacatcctgagtggtaagaaacactgtattgaggaggtatattgaccgtaaaatgccaccttaatttggtgaaagtagttttccttaattgtccaatgaatgtcaacatctgagtgattccattacacaaagagctattttagaaattgaatgctattcagggaaagtctttcctaatggatttagaagggtttaaatcaataagatgacaaaaacaacggatcaattctaaccatctgaaataaacaaacttaaaaaaagttatttcattttattaatactctgggcactgccacgattccccgcatgactttgagaaagtaaaccattttgagctcactttctttaattgtaaattgagtctaattatccctaccttgtggctctctgtaaggattaagttacatcatgtatataaagaatagcccagtgcttggactagaaaagtgaccattaaaggatatttaggctgggcctggtggctcacacctgtaatcccagcactttgggaagacgaggtgagtggatcacttgaggtccagagtttgagaccagcctggccaacatggtgaaaccctgtctctacaaaaaattagtcgggcgtggtggcgggcgcctatagtcccaactactcaggagtatgaggtaggagaatcgcttgaacccaggaggcggaggctgcagtgagccgagatctccccactgcactccagcctgggtgacagagcgagactccgtctcaaaaaaaaaaacacaaaaaacaaaaaaacccattgtattttcatctttgaaattgcagtttttcagaaaccaactagtttaaaattggcaatttggttaagaggttattttttgtatttggagctttaaaataattgaagtctatgaaccacaaaaatgttgagagtggtaaaatgatcactttaaatgtcggtggtatttaggctgcagagactgcaagtctggaagaacagctgcaaggatggggagaagtgatgctgatggctgataaagtcctccgatgggaaagagcctggtttccacctgccatcatgggtgtggtttctttggtgtttctgtaagtgagctattagattactatgggttgtgcttcttattaataaagactttttaatatatagcttctgtttgtgggagtgccttaagtcttctgtaatatataacccataaagaacccataaagaatgtttctcataagcacttctagtttccagaatttgtagtacttctgtaaacttggtaacctaaagcacttgagtaaatcagtgactcgcaaactttttgtcctccagacacttaaactctttttttgttattatactttaagttctgggaaacatgtgtagaatgtacaggtttgttacataggtatatatacatgtgccatggtggtttgctgcacccatcaacccttcatctacattaggtatttctcctaatgctatccctcccctagtcccccacctccctaaactcttaaaaaagtgctgagaactccaaagagcttttgtccattgatatatacttaaccactgcagctatgatatcagcatgtcacaaagcctctggaaagccacttgtgagaaaattagaagaaaaatggcaaatatctctgagaggcggtgaatagttaagtgaatagttaagttagacatgtttagttaggaataataatgactatgtttttctaacctttattaatttttttaacaggattatctactatctagatccatctgttctgtccggcgtttcctgttttgttatgtttttgtgcttggctgactaccttgttcccattctagcgcctagaatttttggctccaataaatggtaggtagcataatgatttggcagtctcatttttgtgtagttactgaacttggtggctgtgattagtatgctgtaaataagcagagataattgtctaaccatcagacacctaagcattagatttattgcttttatgtgaagaatattgtaactgatttgaatataaactatgaattttctgtactccatagttcttttatggtaaatgcacatatacatttttacatttccattgatatttaggatagtataataacttcacaaattatttttgaatgaatacagaaaaggaaactggcagattttcattcacattcatttagcaattatttattaaatgcctactgtggcaggccctgtaaagtactgtgaaatattttgacttttaagattgatcttgtgttaaggctgagatactgagacactgaggcagtggaatggcagttaacaaagtgaataccaagtgtttccgaagaggttcaagctgtatacacatgggttgctgattttatttataccattctcttttttttttttttttttgagatggaggctcgctctgttgcccaggctggagtgcagtacgctcttggctcactgcatgctccacctcccaggttcatgccattctcttgcctcagcctcccgagtagctgggactacaggtgcccaccaccacacctggctaattttttttttttttatttttagtagagacggggtttcaccatgttagccaggatggtctcgatctcctgaccttgtgatccgcccgcctcggcctcccaaagtgctgagattacaggcgtgagccaccgtgcccggcctatttataccatgaggttgcttatgaactcctcagatatagttaagtggataaggatcatattaaaagtattttaactttctctagcatgttgagttttgattcaaataatcagccaaaatagaagttggaatagatattttcttctcagctgctattctatccttggctgtttattttatttggttagtattctacttgtgcctttggttgtttgtatctcagaggatagcaaattgcaaaataattctgtaaatataagaattttaaatgtgtaccttatggatctttaagaacaaattcaaagtttgcttaaattatgatataattgacaatatttaaaggtgtttcccccaacagcagaatggattagtgttaggaactgtccaaattgtttttcacttgcagtaatgaatcaatgttgttggctcttttgggcaagtttctgaatgtgcagtataacagagttagcaaaggaaataaatcactgaccttggccttattagccagataacattccagtctgctaatttataactcctagaggaaagtttgcagaaataaccactgatagtttcgtgatgtgactcagttattgatagagcagattttgtttattttttgatcttacaaggaagaaagaatactcttttgcatagccacaatctagccttgaccatgggcaagaaataacatctcattgttgaaaagaagttccagggctcagcagaaatccttgtactttatctatcactgcagttttacagagatgagggctagagaagagaaggcaacacatccctcagcacagggcaataatagcagccattatagctgtgtagcgaagacagtgcaaaggcaattaaaaaaatcagaaccaagaaaaacattataaatataaaaggttttcttggagggtctcttgttggatttttactgctgtgttgtttgttgattatattttccctccctagggataaatttacaaagaagaatttagatttgagctgtttattgctgccttgtcatcagatgtatgaagcccagttgggggtgttatgtgttaaatgccagtagttagtatcttactaaggagtgttcaaatacagttgttcggtgggattctggtaggtatagtgcagcatttactaggatctaaagaatatttaggaatagcaaaatcaaatttatactgatttctttatggcccatagaagtcatgagtcttttactaccattaaataaatgtggcttcagagccagagatgatcctttctttatcacacgcacacacacacacactctctctctcacacacatagtttatgtaaatacttactcctgtgctataaaaggtgtcttaatggtggaaggattttttcacctacataagataatggtgaaacattgtttttatttttattttctttagaagatagctcttaaattgaacagggtgtcatgtttttgtctactgtaacgatttgtttatagcaaaaggcaaatttcttttctaggaccactgaacaacagcaaagattccatgaaatttgcagcaatctagtaaaaactcgacgcagagctgtgggttggtggaaacgcctcttcacactaaaggaagaaaaacctaagatggtactttttttgctttgacttaagtacagtaaaattttaagatttgagtcaattcgcctttttgtcttaatagctataatttgaaaattattcattggttaattcctaagtacattcataaatgtttacctgtattaattagactgaatcattttaaagttaaaaattacatttttgcatttaattttttattctaataaaacaaaattcttctgtttcatttttcttactgaaataatagtaaaagacatatacttagaaagcatctgtttaggccgggcacagtggctaatgcctataatcccagctacatggaaggctgaggatcacttgagccctggaggtcgaggctgcagtgagctgtgtttgcgcagtgagctgtttgcaccactgcactccagcctttgtgacagaatgagactctgtctcaaaaaaaaaaaaaaaaaaggaaagcatctgttcatctgttctcttatctgtaagcttcacgtcgtgaggctgttccgtgaagttattaactgaaaagatcgtataatttatatcataaaatatttacatacagaattgcagtaattctaggaagaaatgtatccaaattctataaagtagatccaatggaataggtttttaaatctaagaatttttaaagaaaagtgataataaaagctaaattatttcccgaactttgaaacacattcttctttaattgacaaataaaaattacatatatttatggtgtcacatgaagttttgatattaaattcttgttttcattgctagtacttcatgaccatgatcgtttcccttgctgcggttgcttgggtgggacaacaagtccacaacctgcttctcacctacctgataggtaagtctttgaggaaaaactacaggcacatcctggccagtgaaatttaactgtaacttcgtcagtaaacagctgaatacttcctaagttttagacaccgaaaaggaactgtgggaatatggaaagattattatggtctcatagaaagtgaaaacaatgcaataaccaaggtagaaagtaatgtgcaagaggtaaaaataagcaatgattattttctgaggtggaagaggggatgagagcagaagtttctggggatacatcccagtggaagtaattgatttcatgttgcttcctcccattactgagtttaataatgtaggaacctgccttctttaaaatgtaataactggctggtcacggtggctcagcctgtaatcccagcactttgggaggctgaggcaggtggatcacttgaggccgggagtttgagaccagcctagccaacatggcgaaaccctgtctctactaaaaatacaaaaattagttggatgtggtggtacacacctgtagtcccagctacctaggaggctgaggcatgagaatcacctgaacccaggaggtggaggttacagtgagctgagatcacaccactgcactcaccaccccccccacccaccaccgccatacacacgtaataacctctgatcacctgaggtcaggagttggagaccgcctggccaacattgcgaaatcacatgtgtactaaaaatacaaaaattagccaggcgtggcggcaggcacctgtaatcccagctactctacttggtagggtgaggcaggagaatcgcttgaacctgggaggtggaggttgcagtgaaccgagattgtgccattgcactccagcctgggcaaaaagagtgagacttgtcgctgggtgtggtggctcacgcccgtaatcccagcactctgggaggctgaagcaggcggatcacctgagattgggagttcgagaccagcctgactaacatggagaaaccccatctctactaaaaatacaaaattagtcaggcgtagtggcgcatgcctgtaatcccagctacttgggtagctgaggcaggagaatcgcttgaacctgggaggcggaggttgcggtgagccaagattgcgccattgcactccagcctgggcaacaaaagtgaaactttgtctcaaaaaaaaaaaaaaaaagtaataacctttagcaggttaattgctgcctccttaatgttgggtttttttttattttaagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatctt

SEQ ID NO: 175 - DNA, 102779 bp, Homo sapiens
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaaggtaagggcccccagcccacccccggacgctcggcttccccccggggccggggcactgcttccccggtgggagagtgctggagtgccccgcggcccgcggccagtccccgggtccggacgccacgaggcgggggctcggtccgggcgcagagccctgggggagggggcgcggagtaacgaggggctggggagaatgagtttgccgttgatttgcccaagttgtttcctctggctgcgcgggagaaccgagcaatggggccgcgagggctggaggtccgagtaaaacggggaaccgaacgctttctcttgagcttctggcagccctaccgaccctcgccctctgaggccggggttccggacgcctgagtccagcctaagggcaaggctgggaagagggtgggatttcggatttcgggcgagggggtgagcgaaaagctgggtcccacctcccgaagatgttgccaaggggatccccctactccagcccagcccctcgggggtctgagtctgaatcacggctccagcctgcctggggctgccccctctagaggaagggaggggtgtctcggcgcctctagtggggatttggaacccctgcccacggaggctctgggtggagagtggagttccacatacagcttcaggcccgcttgatacagagggggggaactcacgggggcgggggcagaggcggtggggggagggggctgacactctacttgggctcaggaaagtgttgctgtctggggcttatttgacactggcaggggagaggctgggaggtgagggaggtggttgggagagatgaggatgtcagtgtatcctgggcagggctggggttgggggagggaagagggctgagggaaccaagggtccagactgcagcagggactggggtctgtgggagttggttcttgcctcccaggtctgactctaaggaagactgaatcctgctgaactccttccctccccaaaaatggagctgacacacagaaattgacacacaaacaccgtaaaacactcacagacactgagacagactactcacctactgagagagagacatccccacaaacatcccccacactgagacagacacatatacacaaagacacggagacatctgaggaagacagattcctcccccagatcggcacacactcacgcattcatccacccgaacgttacaactatacacagtacatgtatgcaggcgtttacaaggacaggacacacgctctcacagaaaccaaccctctagcaaacaaagaaacttgaacagacattcatatgggcagacacctatggagatgtacagactgcagatggaggaggtgtcctcttttagggggtgtctgggaatggatctgggtagaacagcctcaggcattattgccctgctttctgttcccttcctgcgtttgtaggtggtgtgttatgctggacctttcctctccttgtcgggtctcttcccagttccgaaggcaaagcctggctgagttggtgggggcacgtcttgattcatttctccccacagggcacccatgccagccccccagcacacactatgatatgggaagggcacacatctgtggtgtgagccaggagtgggaggtggtgctaggggaaaggaggaggcctggccctggggttggcaggccaggccagccacttggcagaaagttgggaagatgacttaagttctgactttgttcagccaggctgttggtgtcggggaggaagggggtgggccatggtggtggtggaggggggtcatgttggtggtggaggaggcccctgggtcagtattggtctatgttgggggcaagcttatgtctgtccctttcttacagcccttacatgtcagcatcatggatacaaatgagtgttaaggaacaaaagcagcagttagcaaacaggagagacatgtggattgaattggggacagaaagaattgtgtgttgtgtgcctttctctctttggaaaggagcgagtggctagggaatgctgagctcccacttctctgctccaacaggggtgaaagcaggacctggtgaaagtgtctggggttgggggagaggataccagagaaaagaaagggagagactagacaggaggggaggggaaatcactagtgagtgttgggggaagcttggcaagggactggggaggaggcagagagggaaggagtaggggtctggggagactgggacacacatgggggtggagagcttggcaggaccccctttccttagcctccatcctcagaaaggagctctaggtcagggactggggcagtgagagaggaaacggaggggggcgctacaaaagggaggaggaatgatggtgggggaatagggatgggggagtaggtgtcagcaggaagccatagaattgaggggagcagagaggagaggggaaggggagattcagcctaggctgagaaataaaaatcgcattttaaagaatttcaatgggcttcatcaatcttcatttttcactaaataattttctgtatcttatctaaatgaaaaccattatccttccccccgtttccatcatgcgccggctccacagactgattgcgccgaaaattgaaatatttattcattttctgggagattttctcgctccctagtctcggggaggagaaattgaaaaagaaagattatagctaatcagagcaatgtgggatgacaggccggctcggggagggagctgcctccgtgggggggatggatgtgggggcaggagaaaaataagcccacccagcccccagagctccccctggcattcctgccacagcttttgaggggagtaaagggtaaagggaggaggcccgagggcctcctaaattcccaggattcaactccctgagtacagctgaatcctggcagagaacagcaggtctggagagtaactggactctcccctttcggtgctacacatagacacatatacacactttagatgtcccacttctgcccagagcagggcgctgaggttggggaagagtcaggggagacatggcagaaaccaggacactgggttcctctctttgaccttgactgaactccactttctgccttctactcacttagacccaaagggagggtgtgaaccaagtactcagtgcctcagccctgggccccagagcacctggtcaggaggaggaggaggaggcatccaggccttctcgcctctgctccttcccacagctgagtggttggttgttctggctctgcctttggcgctccagtgagatgggaggaggaagccccacctctgcccccctaggacctctttacacccttacaaggactaagtcttaatttcttttatcctatagtttctggtggtaagtgccccttaaatatctgatcaattgattgatttgatgagcgcgctgcagtgctggaaagaggcagcattcgatggcgattaaatcacagactcgcatccagctcccacctccaccatttggtagtcgtaagcttgaacaagtcatgtacattccctgtgcctcagcatgctcttccagaagtgaggatggaagtaatacctcatagggttgtggtggcacttgaatatgttaatccatgtaacgtacatggaacagtgtctggcacagcgagaagtgctcagtaaatgcttgctatcttggctttgaggtgagacatagatagacaggcagtcaagttgtctgcgcttccttttcttctccctatgattctttgtggggtgtgtgtgtgtgtgtgtgtgttttctagctccagctccccagattcttggtcctgggcttcagtaagtgccttctttgtatctctcatggaaagaactatgttgtggcagacccagaaggggaaactgaccccctccttggagacctcagaaaagatctggggaagggatttgaggagagagagcaaaagtggaagaggttggcacttgagtgagaaggaaccagagctcttgtgtgaaatgaggagggacactagccccgaggtggcagcatttcagagtctggaaataatatggatcatttattgagccctgtgtaactacttcatatgcattatctaatttaatctatgctacagccccctgagattggctgtgtaaattatccccatttcatggatgagaaactgagatttatttatttatttttttagatagggtcttgctctgctgcccaggctagggtgcagtggtgtgattatggctcactgcaacctcctcctaggctcaagccattctcctacctcagcctcctaagtagctaggaccacacacacctggctaattttcttttttttcttttggagagatgggtcttgctaggttgcacaagctagtctcaaactccaaggctcaaccgcttcttacatctcggcttcccaaagtgccgggattataggtgtgagccactgtacctggccaagaaactgaggtttagatacattaagtatcttattggtagttgtaggaaccagtggatcccacagcctgcacccttctcctttgccagatcctacatgccagcagagactgatgctggactgggacagggattttcctggtccatagcagaatgagaactaggaagaaaagggagtgagtatttcataaaggtaaactcattcaaatttaaaaaacaatcctttattctgagattctgtcctacattttttggtgttaaattgtttttctttgatgatatgataaatctagtaaatgacttttttcaaggacttggcaaataaaaaggtttgtttctaatattaaacacagccttgttacaggtccatgaactacaaatttgggaattattcttgttccatgcaaggctgactcctggagaggcccagagccatacagaggcaaaagaagcactgagaaggggtctaggggataatcctgagaccaggatctccccaagtgtcagcttccaaatttgtctggtccctggtagtctggtaggattggaggctagggtcttagatggcttgttctaacccgcctggggaggctttcaaccctccttcttagcctgtgccctggggaactgcctggccttgggtggtgaaaagtgattgtaggaggtgaactccataccaaagcatcaaaattaccttttattgaattcctacagtgtgcttttcaggttaatgttactcccattttatagatgaagaaaccacagttgagagtttaagtaacttgctgaagggcatacctgaggtgttagaccccagattcaacccctcttttgtctccctcctaagcgccatgagtgcccttcagcctgcctagaagagccacaccctgcctttcttagagttaaggcagctgtggaaggacaggagggaagcctaggccttttttcctctcctggtgcctcactcagctcagcccccttccctagttctcagcccagaaattccaaggacacatctatctccctgccttgctttgatgatcatttgtgaagcaaaacttagatgtcaggatacatgttttaatcagtggggctgggaccagtaaataatgccccttgtcagaaggaggtttggaaagcctcaatccttttcctcccacgtttagagtcttttatctttgtacctgtatggtgcttggcaattttagcaacttttcacatgtaccatttgatagagagatacactcatcctatggtgtaggcaggagagttgtttctccatttaatagatgagaaaacagagacctagagaagttaaataaattgcaaaggggtggcagttggtatggagggaagggatggggacaaattccttaatctccccaatttctgggagatgtttccatctgaggctagagacatttctcttcatatgtccagagatgagaaagttatgccccttcccgacctaccagttcctgtctggtttcttcccagggcctctggaccagtttacttggcaatctcctggagggttctttgacctggaaaaggatgggggtgtgggggtgggttgtcagcagtagaggagaaagaggctgtcatgtccttgatcctcaaatgtgaaaccagggaggaggaagaggcaatttcagaaatcaggaaaaataatgggctctctcagagtgggggagaaatccgttcacttttgtgaagggcaattttgtattttacatgcattagtaactaattcaatactgacataattgttgaagttaggtgttatccccattttacagatggacaaacagggatccaaagaagttaagcagattgtccaagatgatccagctagtaagtgacagagccagaactagaacccaagcaggaaagatggggtgggggctgaggataattcctagaaggaagactgcacacctacctgttctgcattactgctgcatgcaagcgtgtggatgcaatctcactgcatgcatatgcatatgcatatgtattcacacatgccttcatagtgcagctatacatgcacccacttcttatccccatccccatacacatctggacagatatctctcatctttacccaagccttttcagtcaccagagcactagtgtgcaacagtagtacatttttgtgagtcatttttcttccagccatagcagccctcctgtgtctttaaaggcactactttttgccttgccttgcatgccctgcatcctctctgatagatgcacaaactgtgaagttatgaaagttgagaaagaagcttggggttcctcattctgtaacactggtccctctccattctgtagctccagctcttataccttcctacgtctgattgtcagacaatgcgaacctaattaagttcttggagcatccaggataaaagctgctgtagctcgcagacatcactgaagtatgacacttttgttttttctttctatcccacttactctccctctatcagctgactccaagctcccagcttgtccttccctccatatttaatttattcagccacttttattaacctctgttgtctccaggggctgcagtcctcatccctctctgccctccttgagcccatttaacaaaataggcatcgtattgaaataaatgagccttgcagccagtcaacctcctcaggattaagggtcttaaatccaggggtagaaatctccagaactctctagcaaattccattagtttcccaggagagaatgctgccgcttcattccttttgcaatctggctctggaaggtgatgggagactcacccagaatgctgtgggtcttgggttttgaggcagggaagggataacaggaacccgagtgtctggaggtgtactctgtgcccagcaggtttatcccaggaagctgtcccatcctaggtccgcttcagaatcgactaggccattggatgccttttctttttgccccttctttccttctgaggcagtctgaggaatatatcttcactgaaagatgtgtggaaagaggaaggacttttgttccttcattcagcggaagagaattgtgtgcttactgtgtgctgggctccagtgttgcaaagtgaataatgtactagatctctgcccttgaaggtctcactttgtgatttcagtgcaaattacttaatctcagtaggcctcagttctctctttcaccaaatcaggagaattatttttttaatcatcaactgtacattattatatgcaaaacatactggtaggcattatgtggaccaaaaaatatgacagcaggtggtccttcccttttaagaaactaagatatacacacatgaagactgctggtggtgcaaggtgtggagtcattggtgccgtgatagcagtgtgcaggtcagagctagagagtccagagaagggactttgctgtgggctgaagtgaccaggaagggctccgtggaggaagtggggcccaaggatggacaggacatggatgtggcaggaagagggagagccttaccagatgggccagacttccggaaccaagatgttgctggtgggatgtgtggcggacactgaggccagttggactgaggatttgggttggtttgggagaaacagatgagatgatccagaacggcagaatggggacagaccagaggaggcctggaaaagccaggccaaagacttcttgcaaagactcccctgtaagaactggggagcaatggatttctgttttttaagcagacaaagggtgtgttaaaaacaggtataatccccatctcacttctcaccaaagcctcccctcctcttaaacacctcttctactggagacactatggaaatttataacccctccaattaaaaacatgaaaaaaacagataaccaaggtttggccaggcagaagtgagcagaaaaccttagagaaataccagctctgccttgggaagtctcagatctgtgacttgagccagagagacttcggaaggatgaggaaatcttttcctctgagaatacttcagtataagataaagatgcctggaggcagagttcaacggcagtaactgcgaggagagctctgcagcctgactctgaggccaggctctttgttacctgtcccccccaagcttgggccatgtctacactgcccagagtcaaggggagccatctggttccatcagagggcccatccgggtttagtcccttcagggtcaattctgggccatttccactggtctgtggccttagatacatgtgcatttaggagctgagcctaaagattcttaaaacctctgctaggaagtgagctctggtttttcaaatggagtcctttgaagagggtcccaccagggggggtgagagcatgtgttcaacttatgagcattgtttttttaaatggctgtgctgggcctaggcctgggaatgaaaaggtaggtaagatttagtccctgttcttgaggcactctcagtatggtgtgggagatggatgtataaacacatattgacaattttataagataaaggttgtgagagaggtatgtgaaaaatgctgaagcctaaccgtccagtgagggggagtggagcagggagcaggggcagggagggggccacagatgtgaggctcaggggctgcggggcctctggaatgtggtgccacgagatatccaagctctggacaatccccgattgtaccccctgctccggatggaaggagccgaggaatccgaaggagtgaaccctggtccctcccaaggattatgatttccaggaacaaaggcagtttatataaagcacacttcccccaaatcgaatctcccaacctcttgtgtccagttccgtactctccaccccccactcccacccaacagagctgatttctaaattaactttgtccttgtaatcagcttagctgagttttttttattattattatttttcctcctccttcctgaattctcccaggaacagcccggggccttgctcgctccattacccagcattgtcaagccatgagttgcttttaactgcttcttcccattcgattcgcttaactgggaggttattaaaaggaaaggagcagagatgggcaggcagggcagaggaggagagaacatagtagagagagaaggcatttcaaaggagcagaaacccaaggctaggcaggctggcagaatgaagcctctgagagaagttgaagttttcatctctactcctgagtcatccagaaggacatttcatcgagacagtgggactcctgggttttaatccaaaaccttgaggaattgacttgctcctctttgtctcagtcctccccaccactccccactctccctggaaatctaccagcttgacactgtgggatgggatgggggactcccagaggtcccacactccccttgatgcctgaccctcccacacacacacactcgtggctggctgtgctgccagcgccagaaccctccagcattcacccccggggcagctacattgtggttgatgttggatcccagactgacgtgcctatcacacagcacacatctgggaagtctcccttcaccaggcagtgggcgaagtgagaatgcaaactcattttaatgtcagtttgagccaaatataattagaaaggaaaatctctgactttgaaaaaaaaaaaaaatctaatgcatttcaaagccaagttgaaatgacttctggattatctgcaccgctgccactctccatttatgcagaaaatcgagaggggagcctgtaaagtctgtgcctgagggatttagtttgcacacattgcctttggtttcatgccagggtcatgttttaagactggcctttttcaacacaacccggttcctggaattgggaagcacctagagtgacctcctcaccagggggcctgtggcagagtcagcctctttctcagaggggctgcttctgtgtgatcatgaccaagtcacttacttggagcctcagttttctcatctataaaatgcaaatgattacgtctatcttctagggttgttgtgaggattgaatgagaggacctatattaaggaacagtatctgaaatacaataagtactcaataaattatagttgttattaatattgcacagtccttgctttttacagtttagtccaaggcagatcttgaaaaaacagacaatagaaatgagagatgaacaaagaataggccaaatacagatcagactgttaactgggccaaggagggtgaccagtgatgtaggtaatccttgagctctgttctctggggttcagtgcagtgggagctttaggaggcagcacagtgtaatggaaagcactctggtttagaattaggtctgtgtcttggatctggaaactgaatgctgttttgccctttatgagtctcagtttccttatctgtaaaacagagtgatagcacccactttcctcttttgtaagtcctggaaaagcactctcaggacggtgtacagtaagcttaaccatcattttaaaccctgtctttcagccaggcatggtggctcatacctgtaatcccagcactttgggaggtccaggtgggcgcatcactttacatcaggtgtttgagaccagcctggacaacatggtgaaacaccgtctctactaaaaatacaaaaattagccaggcttggtgatgtgcacctgtagtcccagctactctggaggctgaggtgggaggatcacttgaacccaggaggcggaggttgcagtgagtggagatggtgccactgcactccagcctgggccacagagcaagactctgtctcaaaaataaataaattaattttaaaaacccctttctttccaggtttcaacccagtgtgttagaacaatgattctcaaactttaacatgcttacaaaacatctggggatcttgttaaaatgcagattctgactcacaaagtctggggtcagatggaagttctgtatttgcaccaagctctcgggtgatgctgatgctgcttgtcctaggaccacaccttgaggtgttaggggatgctttccttggggaaatagatcttcaacgttctaatgagaatcaaaagaaaatagaattcatttaactgaattcagttttcagccagcttagttgtataacagccctgatggatcattgatttgggagcattgatatgtttgttttcaggaagcagctggtgggacaagagagtgcacagagcttgccagcacgcccatccttagccccaagattgtcttatctaagcccctccctgccacctcactagctccatgccacccaccccaccctgccaagtcttcactcaggctgccagctgtggagttgaaaagcaacctgctggtgtgctggtggaaactcatccatatcggagccagtcatttccactttttttttttttaatgaaaaaagtcctcataattcatctctcaatgggagatgtgggggaaagaattttgacagagcttctggtctgggccttgaccctgttggctttggcttaaaaactgggtcatgagcaagttgcatgatttgggaaggaaggtaggtcatagacttaattgggtgcatgatttgggggagcagtggggaactgtcttccgggcaggtcagcatctcacactcacatagacctcataattgttcaacccacatgatgagcgaactcactctctccctcccttctctgcgcgcagaaccccaggctgtagagggagatccacaggccagaggagagagactgcctgccttcagggttccctggttctgtgagagaagcctggtccttatacttagggaatcctgtccactgggggaaacaggatctcccattaattttccttcacctgctcttctctcccagaaaatcaacacacatttagctatctgcaagtgtgaatgagaacacaggcaaagtacagatggggcgagatcaatagattgggcttcttggaacacagaacctgtggtgagaaatgaaagtggagtgatgattccttaagaacctcaaaatggactctcaaaatgtctctctttaggttggactaatttgaaccaacccagagacatcaatgtttgtcctttttctgaagagaaaggaattcattagtactctctgctcactcactttgatttcaaatactccctggcaagcaggaagttcttctttgtgtctagcctgaaccttccctgctcctgcatggaaattgtctgattgggtattgtaactgaacacgtctccagtcttctctgtgtctggataaataacattttccacaacaggtttattttctcatacttcaaggcaaagctccttgtaatagagaagcaagcccagagaggtcataggcgagactgcctcctgggccccgcgtgagcccaagaagtttatcttgttaggggtcagatttgctttccagcaaaccaccaaggctgtcctcctacagtatccccagccaggaccaggagaatgatgttcacaagaacctggctgagtcactgtgcccttacctgtctagtgtccccttctcagccgctcagagcagctgggggctggaggactctggtgtccttcccatcatttctagccgatggcctgagggaccctcctcctctctccacgggagccaggctgagagcagtgctgacatctgctgctgaagccagcatgtaggaaagtgggcatgggggtgatggcagaggtgggcctgcctcacagccagggccagttttagcttaggagcaggaatgttttcctcttggaatcactcagaagtgtccttgtcccgccttgccagggtggatcccaagagatagcagtgtaagcagagagaggaggggatggggtctgtgggatggggtgcctgcctttggggatctcctagtctgatgaaggagtgtgggcattttcctgggatactgaaccgtataagtgcaaactcaactgtaaacttgaacttgaggcaggagacttggtttctgttaccagctagctaactataatggggggacatgggttcccatcttccccagtgtataaacacctataaagatcatttaaataagggaagattttggaccctgttgtgcatctgcacagaagaagatagaaagagacactggagctgggtcatcagcgagggacgtttcctcagaaggggtggagggaagggaacctgggcccaggtggaaggaggacaccaggtggagcccatgagagaagtgaagacgattcttatagggggtctaatagaatggggtggggccggaaggaggtcgcccagtgagggctatgtgggctggagggtctggaggctgagagctgcggtatggctttgtcaaatgtggtccctgcagcattcacactggccaggtgacatgctttgcacacacacaggcagagccccccgacacctcaggagaggactggggtggaatgtaagccctctgaagaagaagagctcgtgtgtctggggggagagtgcagcatgggcagcctgtcctggagttaaaccgggcttcagcttggagcctgcttgtgggcagcctgggtttgcttgaggatagtgcaccctttaagggtaggagggtaggacaactatggcccggagtcctggaagtgcagctagccctgcagctggccatccaccagcagcccctgtgccctcgcttctctctgcccccgagccggatgctccccgctcctgctgtccttccctgtctgttggtctgtcactctgcaggagtgaagtgcgccctgctcctgaagcatttggagcttgataatttgtggattatagctaactctcgataaagattcccctaattgcttggctcacctcaggttctatcatcaaagcaaagccgggaggcccccctctcgccctccttttctttttattatctcttaattaatcattctggctttcacacttagcagataattacagtctcctgggcacgcagctcattttcataacctcctgctcctagccggcagcgaggggggtggggaggaagagggagagaaggggagagtgggaagagacatgttggaggaagggggcggggcgcagtgagaagaaagggacacttggggtggtaaggcagcctgggagccagaacccctgggctgcccagcaggccccaggggtctctgccagaaggcaggaggctgtgccccttggggaggcctcacctggtccacagtgctggctgctggcacaggctttatccccggagctcccctggcctgccctaggggtacagcaggagatgtgtataggttggtggccagaaagcttagtgaagagcaggagatagtccccagtgaggttcagtcaaccgtgtgctgggaagtcgagaatcgctgtgatagggaaaggaagggcagggccaccatcacaacaggacctggaccctggcctgggaacttttctgtttgtggggagcaggacacctctcctgaggcttgagcccctggaaatgaccagggaatgatcactcagtagtaggatcagatgaagagagaaagggctcacctttactcagcaccatgtgggagctgcgccaggtgtttcacagtgtgctcatcatgcccgttttagagatgaagaaaaccatggctcagagagcgcctgtcatttgttcgagtcacaacaaattaaatccaggtctgtctggttagttgtaaaggtcatgttcgtaccacccaatggccctgtctccatggggtcagcacaggacaggatgtaatggaaaaagggagggaggggacaccattcctgctgggccctcccctctggacccagcagatggtcagctctgctgtcacctcggggctttccttgggctttcatcccagagataaacagaaaggacacccgtccagatgatgaattgagaggcccaagagacagaaacctttgcccgtgagttggacacacagttggaccaggggaccctaatctctagtgtgtctcgtgtctgtccctcgttcctgttcctcagcagttctttgtgccccaagcttcttcaggtccccgagaagcggatgggggacatggaaaagtccttctttccctggacatattgaattttctttcatgaccctagtccagtgtgcctggtttttagaattaaatgaggtggatcctacttctttgccattaactagcagtgagatcctggaatataaactttgagtctcaatttcttcattggtaaatgggaatcttgaaaagactggtgacagtatatgcaaaacagagcctctgacccatgataggtgcttaacaaatggtggctgttgttactactaccattattattaccaccatacatgaaagcacctggcttagcagacagcacataaagcaagttagtttcttaacaagtttgtgagggagggagggtccttttgttctacttcctcgaaaaaggagggaaggcacacaatttctaccttgtgctgcttctagggtgtgctattgagaaaagtcatggcagcctgttctggtataattcttctttccacaaataaattgcctgttcaagctggggctgcttctggctgaaagctcattggcacccagctccaagcaaggctgatcttgcctctgccgcctgccagacctcagattgcccacctcaagcctgtgtgccaaagggttaaacatagcgagttaaacataaaagggttaaacatatcacatggcttgcaacttctgactcagcttctggtttcctgggcattacaataggaacatctatattcaggaggcagtatggaaagagcactggattgcaggtctagatgtggattttagccccatttgtgcctctactggagagaccttactcagtgacctgggcctattttcttatcataaaatgagaaggttaatttccaagattctttctggctgcacagttttccaactccttcctatccggtaagagttcatgaaaaggactggctcttcccaaatgaggccctggatctctctgatttggtttataagccaaggccagaggtactgatttcagagggccagagcaggggtatcccaggagcagcgtttgctcaggaaccagggtggaagcaaacatttcatgcatcttcagatctggtctgaacttggggtaaggagagcaggagtccccaccataaacacacacacacacacacacacacacacacacacaccccacacagtcctgagaatgtcacacacatgcatacacacacacacacacacacacacacacacacacacacacacacacacacacacacacacacactgtcctgagaatgtcccagcctgccctggaaggtggggacctggaccaacggtgtgggtgcttgtgtatgcatgttgataagagtttctccccgaagaaacatgctctggctttgccctgaactttagctttggtctatgaaaaggttttgctgaatcttgtgggaacataaacattcggcagatttctttccctgaaagctatttcttctctttttctgggaacttttgccagcaagatcaagggccctccacccttccctcctccctcccctttgcctgagacacccaaccccctttctcctcctctcctaaatgaaaacaaagttaactggtgtgtactgggaatcatttcagagcaaactgggccagaagaaaggagtaaagcaaacagatagctctcccaagaggagaaattataagaagggaagggaggagagagagagagaaaataagccaatggcatcagtggtgaaaagtgaattccagacatttaaaattcttttggttttaatcatctcagaggctgaccagagctgagctgtgggggcagggaaaaaatgaaaaccagggccctctacttggagcgggctggaatctcagattgtctgcaaagaccgacagccttcctatgcaagctgctcactcttctcagcccaggccctcatgacctcctgtgtctgactgcagatggtttaccgcctccggagagcccatcctgactaaccctctctttttatctcactttacactcggttttcaagcactgacctttcagttttccaaccggattgcaagttccccaaggccctggattatgttttgttaaaagcaaaactaacaaacgacaaaccaaagcctctttcataattatgccttggtcccctgcgtgagggttggaccctcggagaagccccaaggcctcttcctcatctgtaaaatgggctgaagagctgagcccagccttgaagagactctagaaggaaccggaagctgggagaagcctagcggctggtgcctcctctgtgctgtgctctattgggcacttcaggattctctcaaggctgccctgtgggaggggttggaggcatttcgctgaggcctaggggaagtagagggtcttattgtcccctttctcaggggtaggtctggttggcagtgggtgaagctcctggacacaggtggctgggagatgggatgggggattccaggctctctccttccctgggccacagtgggttttaaggtgaaggagggaaccaggaaatcttgccagctgtggagaggtgattggtgggaggaccggagggcagcagtgggggaaggagcctggaggagaagcaggaggccaggcagtggccacgaggacgtagtcacacgcagaagcctcctttccctggaccgggtcccctctgtggtcagcatctttcttctttctgagctccctcccccagctcttccccctcaatgttgagctctcagtttctttctccatctggaggcagctctcttcattctcatgaccaccagctgtttctcccactttccccctcccactttccctcaaactttgattcctgggcctttggacttaggtctgtttttcatagtgtatctcccacccctgcttcccttccccaataagattaaaaaatgtagagcttgagggtagattagagttgaccttagaataggagtcaggtgacctggattttaatctcaactcgtcttattggactgctttctcttgggcaagacatgtgcttttttggggccttggtttattcagtagtaaaatgaggagctccgtaaatgatgcctgaggccagatgcttttcaccttctggaaaaaagagcaagatctggagttcagactgctcagattcaaggacctgtcacctcctacccgtgtgaccttgtgcaagtcacttcacctctttgtaggagaacagtggcatctgcttcatggaatgatgataaagactgcattaaattacctgcatagaatgtgtggcttggtacctgagacactgtaagccagtggtataagttagctcttattgttaaatactaaccttttttttggtgtggtgtaataaaaagagtcctggatttgtaatcagggacctgagttcacattccatcttcctttccaattgtctgtgtgaccttgtgcaagtctgtttccctaatgctttataacatggaattcataagtcctgttttgcccctcactgggagttgtgaatataagttaatgtaaagtctataggggcaagggccttctttgtctcagcctcccattacccgcctagtgcatgggcactcaacaaatgtgagataaatgatagtgtaagttactaatctatgaacaaagaaactgagtcccagaatggggaaatgacttgcttaagctggacacagctaaccctttgttgtgggggctgtcctgtacattggaggatgtttagcttcattcctggcctctacctactggaagccagtagcaccccagtctccaggtgtgacaatttaaaatgtcttcagacatttccagatgtcacctgggaagtaaaattgccccaagtgagaaccactgagctaaccagaggaaaagctagaactggaaatgaagtcttctgactccccttccatagctttttctaaaatgccacactgctgtccatttctccctttatcccataccccataaaatttagagagagaggtttatgttgttgaggatgaagtaaagtattttgtcttctagcccatttcagagataatttccacataagctgcgactgacctgtctgtcctgggttagggctaaggaaggaggcaggtggcaaagagagtcacctgggcagtccactaagcagagtggacggaggacctgacttcccctagaagcatgccatgtttgtgatgaggattcctggacgatctaccacatctccaccccgagcagataaaagcagactccttgtgatgccagacagaactgttttgggtttcaggtgcctacggctccccgtttcttctcaccttgcataccccaccccatgccccacagtagctctgagaggacctagggcatcgtagagtacagtttgaaaattacagatttattccaacccttgaatgttacaaatgaaaaccaagactcagagggtaagtgactcgctgccccacagcagtgaccagagccacaagttccaccttagtcccctgcccttgctccgcaaccaaggtgtgtgtacacctcccgccgactagaaaactgccacttcatctaggctgtctccacggacctccctgcctcccctaccattccccactgcacagacaaaaatgtcctttctggggtgggggtgggagtaggggtggtgacttaaggagcttactgtccattaattgctagaggaaggtggtggtccctggaggattttaggtgacactgctcctgggactgtcagcagatcccccaccttccctagagatgcccttgtttttcaacctctgcccccatccctcctaaggggcctattcttgctgtcatggcaaccaggggattaggaccagtttggaagcccaaagatatgggagagggcttagtaagaaggcaggtggaaggaggaaatgagagaatgaggtgatgataaaaaaacagagctacgtgggggaagtggagggcaacgaggaaggtaaagggaagggggagatgagagagacctcactagagtaagagagaaaaaggagggaggagggggagggaagagagagagagaaacctcaacttttatttaaaatcagagagcagttgtaagcctggagttgttgccatggcaacagcaaagaaaagaagatagagagcttgtgaagccatgaaaacccaataggggtaaatgtttaaagccaggaacaaaaaccattcagagataattaagtaaccggccgcaggttccatactcctgcccattgtccgggactctgcctgagatcctagcctccttcccgtcttgccttcttctcccaccctttactccttcccctcactcacaaggatttcaaagcagcagccagggaacacccgaccaccctccctgtaatcttctttcctttagcgagggactgacctgcttactccggtcccagtcccttagaccgacactgggcgagctttctctccttcactattaagagaaatatagtctttatgggggggggggggcggggggaaggaggttttagtcagataaatggaagaacttcttgacgctgaattgctacatggataactaagttgtggacttttctttccttccttggatacgacaggcaaggcccacctctgtgttaactgcggccctctagatctctgaattgctaggattcttggggtcttcctcggaaggggaggtgcgttctcctccttccggtgctttactgggactatttaactgtgtttaatgctaccactaattcctctttgaatgcttcttaggatttttccagcaggcttaatcttcccaagcctcaggatggccacaagctaagctgatactttgggggttaggtgtactctgaagaaatttttttttattgccaaagtactcttttgttttttaaatgagtttcataaagtcaccttactcctaccccagacatcacaacagctggctggcccctcaccccatctccttagggaaataatcttttgagtcctgccataccttcagtgtctcctaagaaactgtgagtatcagagagggctgtgatgtccttttcttcctctcatctctgatgcagttctgaactgggggccaaaatagctaagtaggaagagtcctgttttgcacctgcagcactccctcgctcctgcccgctgttatcacccacctccagtcccttcctgcagatactctcaatgttatcctcagactaagccagaccattggagagttgggaaccaagatggaatggttttggccccttaaagaattgcttttactgaactgagcatttggtgctgtgccaccagccctcactgaggaatgctttaaggaacagccctgtgagactccttactgcatttatggtaggaatgttgtccaggacatggttcaacacatcacagtgtccttttatgaggatccacaggagaaagttccagagctactttacctaagcttctggttcatttttttatggttactgtaaattgtatcatgaattttgaaattttcctctttgcactgactgcttggaagctcagagctagaccttgtagttcatctctgatgaggcacttaggatcttatggcatatatttagtatattagttttaccccaacctcaatttatttctcttgtttttagtctctttccctgcttccctaatctccaccatccccatcccagtgtctagtttcttctcttatttttaatatcattgaccgaatctatgtatgctgcttcagattttctatgaaacaagtaaactaattgagttaagatctataaaacatagagcatagtgcctgacaaatattaagaaagcaggctgggtgcggcggctcaagcctgtaatcccagcactttgggaggctgaggtgggtggatcacaaggttaggagtttgagaccagcctggccaacatggtgaaaccccatctctactaaaaatacaaaaattagacaggtgtagtggcgtctgcctgtagtcccagctactcaggaggccgagggaggagaatgttgtgaaccctgtaggcagagcttgcagtgagccgagatcgtgccactgtactctagactgggggacagagcgagactctgtctcaaaaaaaaaaaagaaagcaaagaaaatgtcaactactattttaagtaaacaaataatacaaattgtttctaatctttattttagagatgttgcaaatatggaccagagactgcagaaagctagccagatcaaaggccagcagttaaaggcagtaactatagttaactcccagttgacccaatagaaggaagagccttgacccgagtaacacccagccactgatttttttttaatcttttctttttaactttgggatgcatcatggtgataataatgatgataaataatcagatttgccttgcttattagagttgacttggtctgctatttaaatgagtttctaattccctgctcacaccagactgacaaccgaaaccttctgggtggcaaagggaatcagcctgcctgggattaagatttttccatggttaatctccaaagtgaggaacctacgtgtgagtaattgagagctgacagcatttcgttggatcagttttgcctagtcagacagggagagggctaagccttggaaagacaatagggtaagacaagaggaagttgacagagtgtgacttctatccatttctcagccttgcttgcacaacctgccctagctcaggtgaagttggccctgcattctttgtctcttatttgctcatttccaacaaacctttcatttggtccaagggtaaaaagaaaaagaaaaaagtcgccatgacatctctgttttgttcaaccccacattcacggagcatttactatatgttaggcactgttaggtgctctggatgtgtcaagtccctgcgagctccctttcctgcggagggcaggttccagtggagacactcatcattgcacgcacggcccaggaaatgggcatctccctgggcaagttctcctcattttcctcctttcctgcttcctcctgcgtttctcaagggctctcttcctctcactcttctctgtcattccctcaaggtctttctagcccttcttagttttctctcctaccctctttacctttccctcctttttaagatccttcttttccttttacattttcaagggctttctctcttttttttttcctattaaaatacattttttgcctagcgcagtggctcacgcctttaatcccagcactttgggaagctgaggagggcggatcacttgaggacaggagtttgagaccagtctggccaacatggtgaaatcttgtctctattaaaaataatacaaattagctaggcatggtggtggcgcctgtaatcccagctacttgggaggctgaggcaggagaatcgcttgaacccaggaggaggaggttgcagtgagccgagattgcgctactgcactccagactgggtgacagagtgagactctgtctcaaaaaaacaaaaataataaaaaataaatttctgagaaagaaaatagtttctttttttttctatttttctgttttttttaaacctctttcctaattacttacaaggaaaaaaaagaaggcagccctccctctcaatctctcagttcttttgcttagaagacaaaagatccttcagaattagagaggaagaggggaaaagaaaaaaaaaaagattccagttaaaaatcttaaaaatcttcatcagggtcaaaaacctgacagaaaagctttgtttgaagggaatgtgaagggggaggaggagggaactggcaaccggcaactctcaacctcaaaaggcaaaatatcttgagagttgaaggaaatctggagatagtgaacactcccattgaagtagtggaatagctttgatttcctttttagccagagagtcttgtccttttgaggctggtggaatatgctgagaggaagaattgggggggtgggaagcaggaaactgccattttaatttcaccctgggtcagaattgtcaggagttagggtgactgcaaagaagccctaggcctgaagcctcaggctctggtgtgccgcaccacaccacaggtcccagcctaatacttcccagaaagggaatgaagcagggagtaggcagagtcagggggcaggggaagggctgtgggaactgatgtagagggctggtgatggtgaagctggtgaagccccgggagagacctgtgggcaggtaggaggcagctcatagcatggccatggagccaggaggcatcagagcgtgagatggtgccaacctgggaatgcagtgtggcctgtagggaagcaaggttctaattggtcagctgctctaggactttgaggagaaaagactcagagatgtcccttgattggaggaagggcgaaagcaaaaagtagcatggggcattattgaaagggtgtcaagaatgggactgctagaatgaggaagcaaacataaagctggacacccagacaaggaggagccctggaaaaagaggggaagggtaaagagggggcctccttccctggaggccatctgatgagggtcgatgggccagtttgagaaccatttgtggcaagcgtttaaatcccaggctgctttttgccccagtacctggtatccagccatcgattgatgtgctacgagagaagatgaaccaattttattattagcctgaacaaaacataattaggaggagaaatttgcttctgctgttgcagttgctgcagcaaagaagttacataaggttcattcggatgacttgggaacaccttccctacttccctattcctgttcccgtttctctggcttgaaccaagtaaatagaggtccagagcctccactctgccctctagaaattcccaagacagaaatgtgctcaaggagcagatctaagaccctcagcctatagcggacacggaacaagggcacaaatcgaataagtcagtgcattgtcatgatgaacatgtggacaaaggcaagaaaagggagaagggacaagagagaggagcagactggaggagaaggaataaagagctgaggcatagctctgctcctgtgatgttagaggaagggaaggtggaaaaaaaaggcattgaattattctcagacaatttcagaaggaccagatggattctggaaggaattaactctgttatgtcctgtactagtatcattactacactctaagatgggcaaacgaaaggatttggagcattttggcagatactctttgggtgattgagagggggaggtaggagggcatggctgttggggtgactatatgggggtcgcatttgggctgaaagttaaggccacagacacatcccaggctgagctccacactgacccccttagactgaggctttcactcagggcacttaacttgggtggagggaggcaggagtggaaactccaggcctaattgctaggtctctctcagctcttccagggagcacggggcaggaaattcctcaaattccaggcttgtaggatcattgctgagcttaaccgcagagcaagagaaagaggcaggagaggcagagaactgccttctctccatctttttttcccttgcaattttaaagctgcagcaaatcagaagggtttggaggggctgatggctatgagagaggccccaagcataacacccccgaccccggtaaagaaagtcccaagtctgggaatcccagagaaattagtcctgaattgagtaagtttgaagtcaaaaatagactgctgtggcccgggataagcatttttcccagggtgaatttttttagttcttcagaatagccagtggaaaggaagttgctttaggagcaagaactgtcttgctgaaataaatgatggctgtgcagggagcacattggaaggggtcttggggtggacagaatttccttttgctctaagggtgaaaccagtcaggtctctctctttctgagctctcctcccagagcacctggtcaggatatcccagtcatcacctccgggaagatgatgttccctggatagcccatacattttctcacctccatacctagctaacactgctgcatcagtcccaatgaccccacttcccatcctttactctctgagatctggatttgccttcaagatgcaccccccatgccactttcttaaggtagtcttctcaactccccccaaagaatgaactattatttttggggggcttccaaagcaaattgctttgaaattccaaaagatcatacattctgttttaatcatagtgggttgttaagctcctgcactagactataatgctacttgtggatagggactatgatttgtttatatctgtaacttccgtctcttgcctcttttccccagcatagagcagaatgactgccatacagtaaatcaaaaaaaaaaaaaaaaaaaaaagccgttgagtgaatatcccagttatttgagtgtggattatccacttggtagatccctataattaatgtttaactcaaagtctagtttctcttccagctcagctcctggtactatcacgtaatatgtgctcagagaatgcaaacagtttttaaatattatcttcagtacgacataattaggtgctgctaaaaattcattatcatgctttccaaagccaaaaagaaataacttttgtattatccactccactgctcttcctcagtggtgtggataactgagacataaacgttttcatcataattgatgatgggaccaccttacagggccgctggatttattgggtgccaggaggaagaagcagtggcccatatcttctgtaattctttcttctccagttgctaagctccttggatttgcacagagcacttagagttgatggtcccaccctcagcagcaacctaaaaatggccaatgtgggctggcattgaggaagtatctcgaccaaaacctcaaaaattcacagtaaaaaatgccgtatcctagggctcttaatttttttcttggtggaatcataaaatccttttggttgttcttcagacctatttgtccctcttttgttatcagaattattttctggtgacccggagagattctttcactgcactatattgcagattctccaccaaaaaagcagaactcagctggctgcatgatgccaaaatgactccttgctttggctaattcagtcagctggtgaaagtatcgtggtattatggaaggagccctgtttgaggcattaccctcatcttagtttcattcctgattctgctactaataagctgtgtgactttgaacaggttgcttaacctctctgggctttggtaatcataatccctaacatgtggaagttgggctaggtaaaagcagaggctctttttagctataactctatgtgtaagtctgtaattgaggttaagaagaaatgtgcatatacatgacttttgactgaatactatttactttctataacaggttacaggatatatataaaattatgttttcagtctccctccctttcctgggaaagactgaataggccctagaggttctgggggtgtggcagctgtggtgggctttacaaaaggggtttttttggttccttctgttcacttgtaaggtttcaaagaaaattgtgcctatacttatcaggatatatgtaagcaactgcagagaaatgccatgtaacctgaggtgttaagtactgaagggacaggaaataatactgggtgtggttatggatagtgctagtttggccaggcttccttaaagaggtaaatctggagcagggctcagcaggaggagacatggcatggattgtaaggggagaaagaaatccactccaggtgtgtgggtgggtgcggttggggtggggctcggtgggtagttattaaagctttatgcacctggattcctagtaggcagctattttgggttctggagaagtgggtcaacataatgaagtttgggaggctgcattctgatttctgggcacataaacctggggaaggcatgaagcaaggaggatgctgaagggccattatcatccaaatgagaccagtgggatgtaaaggataagagcattataagtatcccaaaaaagagaatctcagaattatttctatttgagcatttaacttgtgctaaacacctactatgttctgggatgtccgttctggaaaggaccttagaggtaatctgttctatgaattatgaaactgaagatcagagaagggatgcaaactgcccagtgccacccagcggattctgacagaagcagaactagaagccctgattccttactcccaccctactgttcttcttgctacagctaaaaaacacccatattctttgacttcactttccctattgaatttacatctagtgccaaaggggcaccactgggaacacccaggacccctactatagatgtgcttcccactatggttaaaagttaggacttgtcccagatcctttgccagctgctgaaatccaggccctgagatttaaactccccaaacagcctccagaacagattgcataataacttaatcggaagggcgggagagagggtccaagtgttcaggcaagtaccactctgccagctcctctccacatctgcatctgtgggccttctgctaaagtgccagcgccctagcctgtttccagcctcttcctcccacacacctgcacacccgcacactcttacctgtgtatactcagtctgggtgcaaatgaagagagacctggggttaggtccaggagcaactagagtgaccaccctgggtgatgtgagggtccacgggtgtcttctgaagttctttttggaggcctatgtggcccctgttttctcctctccacaggttttggctgcagccatgaagcaggccaaacaaatgcaaaggtcatggcctggaaggttatgcctttttcttcgggccttggaaagggcaaaaagtgcaagttgtgtccctaggcatcattccaggccccattttcctttgggagtggtggggagtggcaggagagagctggcccccagtggactgggccatgccttatcattcttgtctacaaaaaaactccctcaccctcttattgatggtgagggctctgtagttttagacggtcaatagtatgttttcatttcagttagtttcaattcagcaagcatttattgagtgccaggcactgttcagtgctgaggaaacagagatgaatacaatatggttacttgccttccagttaagtaaattttcacttaagaacaataataccagtctcaaatatagcaaagagacagactacaagggaaagtattttggagtgagcataagaggcataattacaggaatccccacaccagacaggaccatctattctccattctccgtttaaaaggcagctgggtaccatggaaagagcacaagtagggggaccgggagacttgtgtgtcttctaccagccttgccattaatatcctgggtgcaccgggaaaatcattttactgctctaacattcagtgtcctaactctaaattgagacaggattaaataatttcttagatctcttccagctttaagatggagtcaatccaggacggcttcctgaaagaagtacaatttcaggaactgtttggaaagtggaaagaaaacgttaagttattgtgctgcgaaaggtgtcctgttgtcaaatatcttggtaaaatggagataggaatgtgtggtagtgggaggggatggaagagacacagggtttttattgttgttgttgtcgttgttttcttttgacgaagtctcgctctgtcacccaggctggagtgcagtggcatgatctcggctaaccacaacctctgcctcccgggttcaagtgattctcttgccttagcctctcaagtagctgggattgtaggtgcatgccactgcacctggctaattttttgtatttttggtagagacggggtttcaccatgttggccaggctagtctcgaactcctgacctcaggtaatccacccacctgggcctcccagagtgctaggattacaggcgtgagccactgcgcccggcctggttttgttgttgttgttgtattttttttttttttttttttttttttgagacagagtattgctctgtctctcaggctggagtggagtggtgcgatctctgctcactgcaacctccacctcctgggttccagctattttcctgcctcgacctccctagtagctgggactataggtgtgtgccaccacactcggctaatttttgtatttttagtagagacagggtttcaccatgatggccaggctggtctcgaactcctgacttcaggtgatccacccacctccgcctcccaaagtgctccaattacaggtgtgagccactgcacccggctgagacacagggttttgaacaggtattgttaacaggtagtgtaggaagtggtagacccagaggatgagggtgggaaggcccttggatccaactgtagaatgccatacctgaaaacataacggtttatagaggagaacttgaaacagatctggcaaaggggatcgtggtgttttccctgtgtcccttccccgacccagttccccagggtccaccctgacctcagaattgaagcagctcagcaccagtggcatttttagaaggaagggaggggtgcggaaaaaccaaattaagtaactccttggaggtgggcacttcttgccctaagctgaggaaaccagaccaaaaaaagagatcctcccttccgatttcttcagccaccactgtgagcagcccaagtgtggctggcagacatcctgtccccgagggacccatggacactcaaagcctgttcctttgtagccgcctcctctgtgtggagaaagcatcttccattttcttctgaccctgcaaactgacctgtcactgggtctcacattctggactaatgcgtggattgaatgcaggggagcgctttggatgagaaaagtcagatgggtcctcctcaagttccccccattctctcttcccaccgggaaagggaaagaatgcatgcacagatttctttcagggtggcggagacaccgagtggagcaatgacaggccctgttaggcccaggaatgaagaggaatggagtaagaaaaggggaaagagaaaactcggggaaacgacagagaaaggggagctgggaataagcagagcagaggccagaggtgaagcaaaagggcaggagaagcaaggaactgaagactctgaggagggacaaaggctaagggtgccccagggagaagggcatcggagacaggatctgagaaaggaaacaaaggagagagatgggggtgggggacggccaaaaaatggtctagagaggaaggaagaaggaaaagtccagaaggaaaaacagccagagaaagaagagagagaggagagaagataaacagagcaagacgaggccaggcgggaagagatgcagccaagagcagcaccgaagaggagaagcagaggccagagggtgagaagatgggagaggaaatgggagcaaaggagatggagaggagagggcaagcagaagaggcagaacccggggagggagccacagaagaggcacgcatggctggtttaatgagccactcttctttcccactccccaggagaggctgctgctaattatgccttcatcctcctgggcaggaggaggtcaggatgtctgaagaaatgccctcccccagcagaagggctgggggaggtggcgtgaagggaggatgggctggggcaggggcaagtaggagtgctgagctggcaggacagcagatgggacccctgccctggttcctgcaggcctctctccctgccagtcctggtggggtggtgggagggggcacacctatttgacttggcactctggcactgccttcctcttgactaagtcataagaaggccaaaggctgagtgagaagcagagaaggagctgcaggctggggtttctactccccagcacctccatggggcctttttctttgccctgtatttctgtctggtactgatgctttgccctctgaatctcagaggcacagaaagcacaccaggggtaggtggaattccagcctctggccggtgtggcttcttccctcttcctgtcctgccaggtaatgtatagaagctaggtctagtatatcttcactgtagacttgcttatctgggctcactgactggacatcctctaggccccgtggaggacccaccactgttaacctaatgagaacatgcaggagatggggacagcatacttagagaaatacaagggaatgggacgctatgtggaaaagtggaaacaacatggttttgaagggagacatacttggttatcatcccagctatatcacttactaggtcttgggcaaatgtccaagcatcagttgctttattagctaaccaagtgccagatacccttaaaagtgatatattactttatgtgatcttcccaatgatcctatgaggtagatattttatcatccccattttacagaacaggaatcggagtcacagagaagtaacttgtccagtctcacagctaagatgtgacagagcagctgggattggagtcagacagtctggcctggagactatgctcctaatctccatgctccaaagctgaatgaaaaaaagcaaactgtttttcctctgctctgcacccccccaccccctacaacagtcaacacagaagacttctgtgaccaaatgtgtggggttttccctgcacttccagcaagcaatcagtcttccagtaagcaagcaatcctttagcagacttgggctgggtgtccttcaattcaactctgacactatctacctggagatagcatcagatcccccaggttgagggctcagtcccacaagactgtcccccacttccaatatcaatcgcaagccccgcattgttttacctgcgcttctgactggctggctacaaattggggttcccaagaccccatcctgaggttttattccttttctctagtggctcaaagaggtaggaaacacatttactggtttttcataaaaggatagtagaaaggatatagataaagagaggcacagagcaaggcacgtgggaaggaatgtggagcttccatgccttctctgggcgtgctaccctccaggaacctccctgtgttcagctacctggaagatctcggaatcctgtccttttggggtttatgaaggcttcattacataggcatgattaatgaaaccattggtcactggtgatcaacttaaccttcagcccctcttccctccctagaggttggggtatggagctgaaggtttcaaccctctaatcctgccttggtttgtctggtgaacacctctcatactgaagccaccaaggggctgccagccaccagtcaattcattagcatacagaaagacacttatcgcttgggagattccaaggactttaggagtatatgccaagagccaggaccaaatatgtatttcacaatatcacaaaagtctttctcagaaatgaggataatacacaggtgtgtggggaaaattagatcagctgaaagcacttggcgcatagtaggtcctcaatatgtttgtgttgtctcagagcaaagcagtagatgttaaattgccttgtgagtagcatagccaggaagctcccagcaacaaattacttcttattagggtgcttggaaaaggattgaccttcaggaagaattaataggatttcagtcttagggatagtgcaggggcagccccagggaaggaatgatagagaccacttcaaaaaagacccacgctcccacctccccattatacttccctgcaggttttaataatgctatttctcatcacctccctacacaactcctcctccgctctcccaccctaccatgtccctgaggtagggtctgctcattcctgcccccaggcttggaacatgccactgtctctgccggaatgccgtctctctccacaactaaccttgaccttcatcttctgccaaagcagctgcagtggtctgcaggaactgagactttattagccttgtctgcctgcgcaggggctgttgggcacctgggtcctcagggtgtacctttgcatggtaatttgcactagttggtctgcccttgaataaaccctccctaatgttggggagtgtgtagctgtgtgatgtgtcccatccagaatggctagagaagggttaatgcaacttaaatgaaatttagggagaatttgggttgcttctttcctctttagttgttcccaaagctggatgcaaattctgcttttaattgtagcaactagcttttgcaaggatctctggagtattcattccatttgcgatgatataccaggcctttgcaaggcataggggccatagtttccactgaggctggaaagcccaggaggcattttcctgggatgcttccacatcttagggatttgctcagttgttattttttcaattattttttctatttttttaacttatgtaactgaaaactacatagcacttctcagtttactagggatttcacagtctctttatttaattttcactacagtcttgtgaagtaggtattattatgtccatttcataggtgcacaagctaataactgagaggctaattctcttgccctgggtcttggtagaaccagataaagtcaggatgcagaacttgaccttctccaggtattagtgtacattccactgcacaacactgtctggtgaaaattcccctacctagagggctcatatccctttaagttgaaataaatgacctttatctttgtggtcatctgttcaaacctttattaaacacataattgcgtctggctcagtgtggatgtagtataaagagatacgtatggtccagcccctgcctttggggcctgcagtctaagccagaggcattgacatggaaaaacctgtacagggcatgtacagcagaatgaaaacaataacctatcgtgaatcaacagcaaagtatttacaagactgtgcaaggcaagggtaagcgcattcaggcataagacagaaggaataactcttgccaaggtgcctgggcagatctccacagtgctagaccacagagtgcatcttcaatagctgccctaattctctctccctattgctgtaacaaaaacctgtgtgtgtgtgtgtgtgtgtgtgtgtgtgcacgtgcgcgcgcatgcacacatgcatgcatgtgcatatatgcacgtatgtataatgcacataaaatatgtataattttaaaatattattcttcaggctgccaatgtacaattgggttggttagaaggtgaatagttatgggagtcttatatttagataatgatggggaaacttttagccctcctgtagcagtatagtgaaatttattctcctccgatgtacatctagtttatctcttaacactgagcctttatgagatggaatgagcacctgtaatataggagagagagagagagaagcaaatagcaactctgaaatcagagagatacgaactttaatcctagacctgctaatgttcagacacaattgtgacattgcacaatttatctgagcttactgagtctcagttgcctcacatgcaattgggaaaattatctctaccttgcagggctgttcagagaattaagtgagatagtataagtaaagcactctataacctgatggcttaatgtatttttgttaaatttttaattttatatttttagtaggtaatgtacgtagtacaaaatataaaaactacaagaaaaatagtgaaaataactctctcccatcattatcttctagctaccatttctcttaaccttaagtattttggtccttacaaaatccctgtgtataaggcaggtcagggtttttgatttttatttctcaggtatggaaattgaagcccagagagattaaatggttacctgaagttacccacatgaaagtggtgggactagaacccacatcttcctgttagtaccccagcttgttgtatttcatgtttcacactagaagatgtggtcagagatggaccccaggctgctgaattttgtgactttgggaccataaactcttttgagaatcttatggaagttatggatcctttctttctcaccctcacatacacatgccattcagacttgcatatattttagatggtttctcaaacactagaatttcaaaagtctaaaccatcccaatacctttatatcatcaccagggttttagctctataggacttctctggagagcagtggagtgtgctcagtgacctgcaaaccgaacctgctccccagggagcccaaagttctggagtcagaagatctgggttctactccaggccgtcgcatatcttagctttgtgaccttgagtgagtccttcaatttctctgaccttaattttctttgtctgttaaatggggttggtattctctgtccccaggagctgtgaactaacatttataaagtcattttgcaaattgtgaaattacaaacaaatctaatatattatttctccctgctaggcctggagcaggtgagaaaaccagaaagaagtagtctcatacctggaatttcatccagtagctggagtacctgtcctatgtggtagaggctgtccagccatgcaccccctctctggatttggtacccagagtcaagatccccaggagtaggtgtgagtgctgactcatgttgcactgaacatcccatcatcaaatcccagctccatctgctcatcctggtccaaagtggacgataatcccattgttaagacatgtctcattaagacttctctaagatggagccagcaaacagcccagtagcatcgaggctgctgcctgggaaagagtcccctcctctcccctgttcattaatgattatgggaggttttattccccccaacaaaagtgttaattagacatcatcggaacagggatattacacaaatgaattaaactcaaaccaatcaacaagctggctctgtgcttcaggtcccccgaacgaaaagggaattgaaggctgtaatgggaaacaaacggtaagatgtctttcctaatatcaaataataactaggaaggctgcctttgcttctagaacttgtcttcttattcttttctttctcccctccactaaacacacacacgcgcgtgcacacacacacatgcacacacacgcactgccatgaggcttggagagttagggttccattcttgtgactgaaactgaaactggctgggactgcccagtggtacttctcaggtgccctctaggctcaggggccaagtgggatggaaggagtcagaagagcccagttccagtccctctctgtcactcaccaccttcctcatcagagaatagtgtgtgtaatgctcaggagttcacagggatgcagtaggtactcaatacttacctgctgtgtccaaatggctgggcgacttctggaagcattctgtgccctggcagcaaattcctgaggctgattgacccctgtggggagagtgggaagaactggagggaaaagagttttagtccttgtattttgagggatcccagttgcttggagggatagataaagaagattgaaaagtcttctaaaaatggacagatgaagccagtgcaatggctcatacctgtaatcccagcactttgggaggcagaggcaggaggagcacttgacccccaaaatttgagactagcctgggcaacagggttagaaaccatttctacaaaagaaaaacaattagcctggtgtggtggtgcatacccttggccccagctacttgagaggccaaggtggaaggattgcttgagcctaggtggctgagcctgcggctgtgatcacacaactgcactccagcctgggcaacagagccagatcctataaatgagaaaaagaaaagaaaagaaaaacaaacaaacaaacacacttgcaaatgagaacaagataggacaaaattaagtattaagaatttaatgtatgatgggaactggggactggtgtccatgggggaaactagatcagggttgagaagtcaggggcagggattctcatggcttccacagggctgggagatggctggagaggataaggaggagctgggcctgtctggctgaagcaggaagttcaggcttgggagcagggagatgaggttggggtaatgagaggctggctgtgtgttgactccctgaaggcagggctgactttcctctagcgtctcaatctcaggaacatagtaggtgcttgaatgcctgtatgaagttggcttctgtgcaaataaatgggctgtaagggaacttgtctctggaattagtaggagtcagaaggcaactgaaggcagaatttaaaaactatttttcttgggaacaggatgcagagggtggaagtgtggaaaaggaagtccattcaaaggtctccctgcaggtctgagaagagatgagctctggatatcccttcctttaactccaggtgtgtcccaggcgtaagaaccgccccccacctcccacctttcactgcttgtccccagcctccttataaatcattcccagcctgtgatggggaatccccactttctttttcttttttctttttctttttgagatggagtcttgttctgttgcccaggatggagtgcaatggcacaatctcggctcactgcaacctccacttcccgcgttcaagcaattctcctgtctcagcctcccgagtagctgagaccacaggcatgtgccaccacaactggctaatttttgtatttttagtagagacgcggtttcaccatgttggccaggcaggtctcgaactcctgacctcaagtgatctgcccgcctcagcctcccaaagtgctgggattacaggcctgagccactgcgcccggccgggatcctcactttcttctttttgagacggagtttcgctgttgtcacccaggctggagtgcaatggcgcgatcttgctgcaacctctgcctcccaggttcaagcgattctcctgcctcagcctccccagtagctgggatcacaggcgcccaccaccatgcccagctaatttttgtatttttggtaaagacggggtttcaccatgttgaccaggctggtctcagactcctgacctcaggtgatccactcgcctcggcctcccaaagctctgggattacaggcgtgagccaccgtgctaggccccgactcacatttgagagtacccccaccactatccccatgcctcacctttaaaggaaacatcggggctttccatgagtggccgccttccctttcgaggagcaccttgcagttctgggctggatggtgactttttggcatcagtgctccacagtgccttctcttccttgctttgcagctcattttattgctcctcatgctcccactgccccaatcaggttgtttgatccttgtctcaaagcctactgctgcagagagtcctctttcttgtttcgcccttgactacatatcatggagctaacatttcaaagatagaaaatgaagttttcggccgggcatggtgactcacatctgtaatcccagcactttgggaggccaaggcaggtggatcacctgagatcaggagttaagaccagcctggccaacatggtgaaaccccgtctgtactaaaaatacaaaaattagccaggcatggtggcacgtgcctgtaatcccagctactggggggctgaggcaggagaattgcttgaacctgggaggcagaggttgcagtgagcggagattctgccactgcactccagcctgggcaacaaaatgaactccatcggaaaaaaaaaaagaaggctgggcgcggtggctcacgcctgtaatcccagcactttgggaggccgaggcgggcggatcacgaggtcaggaaatcgagaccatctggactaacacggtgtaaccccgtctctagtaaaaatacaaaaaattagctgggcttggtggcgggcgcctgtaatcccagctactcaggaggctgagggagaatggcgtgaatccaggaggcggagcttgcagtgagccgagatagcgccaatgcagtcaggcctgggagaaagagctagactccgtctcaaaaaaaaaaaaaaaaagaaaaaaagaaaatgaaatttttctttatccttctcctctttgattttagatgcctcagtttcccatagattcccctttcccaattttcattccattttatatccaagtacttggcattctttatatctctgaaacccaagcttcaataggattctgagcatgaccaaaatggaagggtgttgttttctagtctctgttatccagttacctggaccttttactttgtaatgtgacttagtgaaagtgtgtattaggagtcagatgtgggttcaagttcagaatctcctctcgccagctgtgagaccttaagaaagatatgaaactgagattcagcttcctagggctgagttttttgtggctgaagaagttaaatgaatataaaagtgatttttgaattgtaagctgttcataaaacataagggattgttatttcttgctaattccatcttagcgcagttacttaggcaataggggttgagggacgggagaccctggtgatccacaacttcggtagctagggtagacatatttttggataatgtggggccgtctagttattactgaaaaatcacacgtttatttctcatgctaccagatataaatgtgtactttttttattgaagaaattgaggcaagctagaaaaaaaatttttaaattctctctatattttctatttaacaaacatctttactgaactggttgtgtgtgtgttcatgtgtgtatatgtgtgtgtatttatttttgccattgttctgtttttcttacctccttttcttccacctctttgggtatgtattttatcttggaatctgggaattgaagcaggaactggtaggagccattccctttgccccctggctaggtagctattcaggctccctctctgcctcttttaagagatcaattacttaccatccgtcagtttcttttatcttttggaaggaaacctgtttagaacagcccccttgggactagggccccaggcagcgagtgtagtagagaagtgaggtccagatgctgtatgctgatgtaaagttgcgactgccctcatggagcctgacagcaaggactgcagagttttttccccatctctggcatctttcctccatcagcagagggtccagggtatcaggataatgacaagaccttgccctgaacagtagaagggtaaatacaaagaaaggagagaaatcaagggggagacaattcatatataatgagcacctattctgcacaagacactgctagatattctacttactgttgacctatttattttaattctcatggagccctgttaaataagaattactcaccctatgttctggatgaggtgttaaggctcagagaagtgaaggtggagctgggattcaaacccaggcctgtctgaccccaaatcctagtattttttttaccagtccatgatctgtcggggctttaaagaaccactttgatggagacaggccatgcccctgctatgtggagaccatgtggttaataacagtgattggatgtttgggtgattttagccacagtctatgtcctagtagcagtagtgtcaataatttgggaggaacatacctttgccccttagaaaggcattttactaccccaaagtcccagaaacctacagagccctacagaactacacagagccagggggaactggtatttccaggggtggatttatgcattgacagagtttaccatcatccttcaattctcaacaaatgcagagaaccagagtgtggacagatacttttcctaaaccaacagtcaaaacccagggatactggggattactaaaagtgttgtagtttgtttgtgttttgatatagaagggaccttgggccttgacattacaatgcaagtagactacggtgcaaatggcgccccctggagcacagaattagaatacagaatttccatttatttattcatttattcatttctttatttattactgttccagacttattttctggttgtaacttattcagataaatactgcaacgaacttgtagcaccaattggacagatcagctggaggtgctgggcagtgatagacagtttaggtggcttagggagctaaactaacgtggagaatatgcagcttttttgcagactgagtaataaggggacatgcatgatgcttaggtaacagaaagcagtccactatgtaacctgtatttacaaatgcggaaaggacatggagaatgagagcaattcgagagggcttctagacctttccaggttttggcaggaccttcaaggagagcggcaaggttcacggaggaggatggtgtaagttctctcaaagcagtcacaacccgggaaagagaggcgcttgatggaggagataaacatccatggaccgcgatgcttggtgcagtctcggtcagctcactgggtctgatgtcctccagtctacagtgaagggcttgggctggattatacctgaggcctcctgatgcttatggttttcatcttttctggcctgaagtaggggatagagagggcagtttggggtggacagcaagctgtctggagaagaaagactgggagagcagatgaatgagggccgttagacaggagtgaggacggccgatagctgggctgtgggctttaatcagccagaggagccttggcgggcaggtctggagtgaaccacccggagtcttggacttcgatggagcctgagatgggacagtctcagctgggcccttcagggcctcccgtgtctcctttggttctcctatgttaaagaaatcccagaggctgctgtgggcccatgggtgtcatgcagcagcgagtccagatttggagtcctggacacctgggttctagtcccactgctgccacgactagcactggaccttggcctagttgcttcatccctctgggcttgttgaaaggggtcaatcggccgggcgccgtggctcacgcccataatcccagcactttgggaggctgaggctggtggatcacaaggtcaggacttcaagatcagcctggccaatatggtgaaatcctgtctctactaaaaatacaaaaattagctgggcgtggtggcacatgcctgtagtcccagctgctcgggaggctgacgcaggagaatcacttgaacctgcgaggcagaggttgcagtaagctgagattgcgccactgcactccagcctggcgacaaagcaagactctggcaaaaaaaaaaaaaaaaaaaaaaaggaaggggtcaatcacacctacttctcaggggtcgtgagcattaagtgaatcaatgtctataaaatggttagcagcatgcctggcttatatacgtgttcaataaatgaccattattttaattattattagctatcaagtcccatctctccttccaaaccctgattgtagctccctcctccagcaagcatcctctgattaagctcacaggtctccagttgctcgtacacactgcacccaggctcttgcagcctcactttggggtttccaggtagcagttggcttgttgtcctgagtgtcctaggaacatggtctttagagtggggacctgtctcctttcctccccagattccttactgcccattgcagattttggccctcagggcactgggctgagcccagggtgcctggctgatggacttcctgcgactcataactatttcctcaccaggaaacacccccaggcccagtgtcagctagactcggggcaggaccagcctgccagcggctcaatggctctagctaagttagggtctggctctgtgcccacgaccttcctggggagctcgtctcaggcctgccacccatctgcctggctgatgagggaggaaggccagctatttcttcctgctggaggaatagaggtccgtgtggtgactccatccgttctcctcatgtgtgagctgagtcctgtgcattcatccgtttagttctcaattcagcaaatgtttattgagtcttccactctgtgccccgcactgctctggtccctggggacctggtaggggtcactgtaatgaggctttgctctcacagctgcagggggtcagtcagtggtggtgggagggggcagaggacaatagcaagtaaacaagaacatatggactgtgaatgagtgttatgatgttaaagatgaagcagagtggcatgaaaaaatctggtgtcttccagtccttttacaggtggctcttcctcttttttttttttttttttttttttggaggcagggtctctttatgttgtctgggctggtcttaaactcctggcctcaagtgattcttgccttggcccccccaaaacactgagattacagacgtgatctactgtgtctagccattctcttcctcttttaaggaatgcttcctagtgtgtggtaggagtgattattcttagccctgggagatctcacaaactgacgactgaacaaaaatagggttccaaagggtctgaggagacgtgaaaaattctgtgtcatgtcaaagaaacagtagacttgcccactaggggctttgttttgttcacggctgtaacttcagaatccagaagagtggtacgtagtaggtcttcaataaacattgattggctccagagggctaaacgaggatgaatggatgtgaacgatacagaaaggcagagttccacagactataaagaacagctttttaatagctgtagctgtcagcagatagagagggctgcttcatgaggcagtaagccctgcagcccgagagggttcaggaagagccaggctgaccacatgctgggcacgctggaccggagacttctgattgagaggaaggttggacaaggtgaccgccattatcctttccaacactgaggctctgccatttcagcaccaccccttcccaggcccagcctgcctatgattttgcatcataaatgcctggactttgctgacaatgcctatgtcttgcttgccatagaattgtccacgaagaggagccctgactgctcagcagtaaaagggaaaatcacttggaaatgtacttccctttactgaccctgcagctctgtcctcattttatttttctgtatcaaattgccaacagtaaaattgctggatgcatggcatgtgctgtttgcttcctttatggcccctcattcccaccatttggccagtagagaaaacaattagtggtattggctcgagtctcaagctggaggacacaaaagcagcaaaggctgagcgggatgtgagagctgggcaagctggggtgaccagagccgggatgcgcctgcactcacattaccgtatgtctagaacctcccaccccacacttactcatcaagccagctttttccccaatcatgccaattgttcctgaacctactgtcctgcagggacctctttgcttgagctcagttctttccttttcctccccactccttcatgtctcctatcaggcctgtgatgtaaatacagtctggtcatgtattgattgtctatttctaggtcttctttccaaatggcctagatgttgctacctgtgttggtgtgttggtctcagagggaggtcccagaagggagagagcttgtctgtcttgttctttatagggaactgctcttgccacctctgggcgttgttgttatgtttttcagtttgttttgatgtgtttggttttttgttttttggcaaccatgccatctccttgtgggctgttgatctactcataaagcagagctctgaggagaggagagagttgatgcacaaggggttctccagtggaaagcatgagactgggcctcccttgcgtatttttcctttgcacaaattgttgctttccttcattattgctcatgtctaggggcataacataatcctcagtttgttcattcattcattcactcatgcattcactcacttgtttgttcaattaaccacagttattgagacccttatgtaagaccattcctgggcttgacctccaggatgtagatataagtaagaaccagcctctgaccatacatctaactggggaaagagacatgtgggctgagaaatgccataaagcatagcaagcaagtcccataatagaggtcagagacatggaaaagaaaaaaactgtgactttagagtcagacagaccagggttgaaattctgaccccaggttttattgtttttatacctactccagcaaaggtttgatggaatgataacatctatcttccaagattgttgtgagggagaattaaattagataatgcatagtcagcactctataaatatggattcttcctctccattgtctaggagaatacaaaaggagttactcactttgcctaggcaagttaggagggcttcacagtggaggtggtttttgagcttgattttataacacagagcagttttcaggtgaaaatggaggggaaaaacatttcagaaaatgggaacaggcatttccttaatatcaaccctagtaatgaaaaggctggtctattcagaggaggagggctggagcgtgtgctaagatggtggttggtggggggctgaagataagatggaaaagaagttgggaacctggttatgaagggccttgggtgaccagctaaggattttgaactttattatcaacaacaaggaaataatggaggtttgtaagcagtaagtgatgtgaatcaatcttgtgttttaggataactctaggggtagggggagctgggcatgtgtggaagtaggaatggaacagaggagagagagcaggtagatgtgcatccaggagaaactacaaccagtcaagcaacaaatgtttattgagcagctattatgtgccaggcactccactgagcatttggaatacaaagatgaattgaataggatccctgggatagacagataaatagggaacacaataaactgtggtaagttgtgctagaggggagaacaggtcctgtagaggccttggggagggtcagctaataaaagatgctgtggacaggccactcatttatccgcataggtgtgcatacatctcacaactcccgtgtgccactcacagacaacttcgtaaggtggtcctggtcttgaagttatccaggagagaaagataggtttgaaccaagggagagacaattcaggaggggaatcatttaattcaaaaagtattctggagttggaattgacaatagatttgagataaggattaagggagaggaagggatccaggctcataacagtccctctgaaggtgctgaggcttgagtgtctaaggagaaaggaaaaccagcagagcagctaatgggaatgaccagaaacctgagggacccctgccctctgagcctcacttctccttatcttagaacctaacccagagggaatcacttctctccaccctcgcttgggctttcccacctctctcttgagattcctatctcagtcctctcccaaaagaaccaggttcaaatctcagctcccttacctactgtgtgcgtgatggtgaacaagtctcccctctggtttgtgcggtgggagaatgggggtgcttggtactctaaaaccctaggctgatgctaggacattaactttcatcattgcaggcagcaggttgacttggatggagtggaagggcatggatttggtgagctagagatggcgaggagggttaggcagttggtctggttcagagatttctttctggggaaggaggtgagaggaacaaattggacctcagaagttcaagggccttcacaggaactcagagaacttgctacattgcctgagcacttctggagctcagagaacttgttcagagaacactgttacattgcccgagcacttccagagctctcgatgtcacaggaggcttggagggagggacaagagaggaagagagctcctccaacaccagaatggaggtgggcccagggccatgagtagctgcgtcgtgtgggtcttctccagggtgtgtgtgtgtgtgtgtgtgtgtgtgtgtgtgtgtgtgtgactcagacctggtaactaaataaggtttccaggtgaacgtgcaggtaaggggggcccggcctagatgctcccggcaccagttgagagtgacctttgtgccctcctattgcttcagttttcactgggaggcagctaagatatttggaagaatctttaacatgagcccaaaagtatttgcttctttggttatgctattacctcattctctgttacctgagcctcagtttccacatgcgtaatatgggataccagtccctcccttgcagagctattatgagatgaggtgagattatggaagcagagctccacactgctgtaacactagctagtgtttacagaagccaggcactggtctatgtactttacagatgcatgttgcctcattaaaaccttcacaacaacctgaggtaggtacgactattccccagttttgcagatgagaaaatggatgcagattggctgttctctggcctgtgctcttaaccacctgctgcaccctctgtgatgttattactatgccttataaattagctttgccggctgggcacggtggctcactcctgtaatccaagcactttgggaggccaaggtgggaggatcatgaggtcaggagatcgagaccatcctggctaacacggtgaaaccccgtctctactaaaaaaaaaaaaaaaaaaatacaaaaaaattagccgggcgtggtggcaggcacctgtagtcccagctactggggaggctgaggcaggagaatggtgtgaacctgggagacggagcttgcagtgagcggagattgcaccactgcactccagcctgggcaacagagcgagactccatctcaaaaaaaaaaaaaaaaagattagctttgcccttcatcatgagggtgggggcactccaacacctactgcgaggaagcagtgctggagagagggagaagctgcttgcagagtggactgtgagatccacactgggagaggctacagatgggaaaagagagtggatggaaagctcctgaaaactgaaaatggtgacataggcatgggatatttttgccccagccagcacctcattccccccttatggaaagagtggcgtaagaatcctgaccccacccctcctccattcctgctcagatgtgctcagccctctcttggcccggctgcacgcctcccttcccccaacctgtggcctccaccccaggcgggatcagatatggtctttgtctttctgcctggctgctccctttcaggggataaaggcctctgtgtctgggaacactgatagttcaggggagtttgagggacagcttgggaagtctgacaggactccctaaataaacgcctttcctctccacccagtggccatatctccccattaccttcccctaggctgggtaccccattaccatgagttctaggggctgtggagaaggcctctgctttcttgggcccctgcttagggggaaagaggaaaacagaagaaaatgtgccttcctggggcacaatgagacactgggggtgggggtgcggcagtggtgggctgtgccatggcagggagccgtgaacagcagcatctctgtgagagatgctttgacgccacaaaggaccccatgtttaaccctatttttccagcttcaccctgcaaattactagctttgtgacattaggcaaattacttaatttctcttagcctccacatttccatctgtaaaatggggttaataataggtatcttaatggtagatgttgaggattcagtgaggcaatccacataaaagaacaagctcggtgttttggacattcattcattcttttagatgtgaactggatgccaaccgcataccagggactgtgctgcatgccaggtctgcaaaagtgagcagctggacatggcccctgcctttgtgaaaaaaagcaatctctgcaaggcatggtgggtgccagatgtaagaagcattacataaaaggcagctgtaaaaaagtggcagaaggaggtgagcccccttctgtctgcctccagagccaggtcaggcttaatgcaaggtcctgcatctgggaggggacagtcatctgtactgactgggaggtccatgcccagagagagcttccatcctctctggacactcactttaatgagaagcggacaaactggacttccctaatggaggacagtggtgaagcttccaaaaattataacagatttatttatttattcaatgtttttaaagtattaggcattttttgtttgtttgcttgtttgtttgtttgttttgagacagtcttgctctgtcacccaggctggagtgcagtggcacgaactcggcttactgcaacctttgtctcccggattcaagcgattctcatacctcagcctcctgagtaaataggattacaggcatgcgccaccatgcccagctaattttcgcatttttagtagagatggggtttagccatgttggccaggctggtctcgaactcctggcctcaagtgatccgctcatcccaaagtgccaggccctttttccaagtgctgaggatacagcaattaacacaaagaaaaaagaaaatctctaccctcatggaccttatatggcttctgtcagagagagggacaataagctaattaataggtaaaatattagttagttggatattgataaaatggaaaataattaagcaagggaaggggaatccggagtctggtggggcagtggtccaattttaagtagtgcagtgagtaaagaacttactcagaaggtgataacaagaaaagatgtgaaggagttcagggagtaggcacattaaggggaagaagcattccaggcagagggaacagcagaggcagaggtcctgaggggaaaatgcacctggtgtgtttgaggaaaagccagtgtggatggagggaggtgagcaggggaactggtgatagaagtgaggagtgtgcctgcacatgtgcacaaatcatgaggggctacaacactgccataccttcccctaggctgggtaccccattaccatgagttctaggggctgtgggaacgcccagaatccacaggttaggtaagggcacagtccccaacaaggactgccctcgtttcagatgtcagcttcaaatttgggagtccccaggccacctggacttctgaccaagtaactacaaattcagtggttcccacaacccctttgggatcaataatttgacagaatgactctcaggactcaggaaagtgctatactattacagttttattacacaggatataaatctggatgaaccaaatgaagagacacacaggaccagctgtgagagggtcccaagcatggagcttccgtgccctctccctgtggaatcaagacgtttcacccaccctgcacatcaatgtgtgtaccaaccaggaggttccatgactctaggagtccagagtttttattgtagttttattatcaaatcattttggcatgtgattgaattcagtctccaacctccctctcctctctggaagctggtgtcatgtggctcagtgccctaaccttctaatcacgtggttgatctttccagcatcctcagccccaatccagagtcacctcattagcataaaccccagtgtgcaatgaataacaaagacattcttatcacttgggaagttccacgagtttaaaacttctgtcccaggaatgtggaccaaggccagaaaaattcttccttattggaccagagccttgaaggaatcacaggacttaggcttttactttgaatgaaatgggaagtcactggtagattttgagcacaggagtgacatggtataattcatgttttaacagaattgctttgggtactgtgtcaagaatagatggtgtgaaggaagggcaggagcagagagacccattaagcagctactgcagtaatccaggcacaagatgatagcttgggcaccattggcatgcctagagtccacaaaaagtggtccatttctgggattattgggaaatgagaaccagcaggacttccttatggattggacgaagggtgagagggaaagatcagtcaaagatgacattgaggctttgtcttacggacctggaggaatgaagctggctttgactgagaagaccaagtttgggggtggaagatcgggagctcagttttggacacattaagtatgagaggccaatgagacagccaagtgggggtgtccagtaagaagtttgagcgatgccactgcagctggagggaaaggtctgagctgggatagaacatcaagttagagatgatgtttaaagctgtgcaactggttgaatttaacaagggagcgaaccaagagggaggggagggccagtcaggacccttcaacaagaagaggaggaggaggttgtggagcaggcaagagaggaggaggaaacccaaaagactgtggggtcctgcaagaccaggtggggaaggtctttgaggagggagggatcatctgtaacaagtgtgctgatccattaagcaagatgaggacgaagatgagggccagtgttggatttagcaacttgtaggtcattggtaactcagcactaaaagttctggtgtgagttcatgagtgaatgggaggagaaggattgtgtgtactactatgcttcagtgcttttgctataaaggagagcagagcatggagggggttgctgggcacagggtcaacagagaggttttaagagaggagagaatgcagcccctttgtatgcagatgcctgtggaaacaacaggttaagaaactagggatgtttggtcatgagaagaggagactccagggatatgtcataactctcctcacgtgcttaaaggagtgtcatatggaagagaattagattcattttatgtgactccatagagaagaactaggaccaatggctacaagctacaaagaggaggattgtagcacagcctaaataagaattttgtgcatccatgtatttgctcattcaggaagtcagtattgaatgcctgctgcatgtctgacactggcctaggcaccaggggtcgtcatgatgaagattcagccctttctggctaatggaagagagcaacacagacaaacaatgattgtgccatgtggaaagtgctgacaaggcccctgtgtctgactggggtggggaatgggggttcaggggaaggtcaggctgggtggagaagtcatcattgttggctgaggatattccaccttctgataaccgagagcctatttggcctaaataaatgagacttaaaaaggcacttgaacctcagttatcaggtccattttctggatggctaggccatgtagatgcagccttcataaaaatgatacctgatatatgggcggtgctttatcatttacagagaacttctaatcctccccacagcctgccaggatcattctgttgtccctgttttctagttgggttaaccaaggctcagagcagtgagccttgcctaaggtcacttcattattataaagatggagctggggccagaacccggttcatgagtccctggtccaatgaacacaccctcccagagctgtgaaatgctgactataatttgccgtctcccttctctgacccatgcacaaaagtactttggggccaggatttgggtctcagctgaaacatttcctaacctcatgccccttctcctgatttcttgaagctttccccagtctggtttctgcaaaagaatctgctctgatgaagccagaaacttttccaccctctgcctggggctttctcccctgctctttctctctggttccaacctttctcttttgcctgatcttacatcacattctcttactttaagaagatctctggacctcatcgtggtctaaaattgttagagtcttcatactttctaggccagcagtccctgggttcctctgatgttggtgagacctattgcgtccaaaaaattaggggagttggatatctaaacactgtaaataagaaggatggaaggaagaaggatagggcaagaataatagtgattattaaaacttacatcaggcttactacctatgaagaattatttatgttatctccattttacaattgaggaaactgaggcacagagcactaaagcaggttgctccaggttgagtagcagagctggttaccaagtggccatgcttagctgctgtgctccactgcttcccttaagaaggaaaggaggagagaaacaagactaggaaaggcgttttttcagcatgattgttttgagccagcagtgtgctgaagctgtgggggaagaaatagatctagtccttgcccacagtgaactcacagctacagaattacagaacatcaaagttggaagagaccgtggagatgtcatccaaattgggacacagggaggtgaagtgaaacacctacgaaggaaaagggaacgcatacttttgcacacatacaaaaatagcataaaacatacaagtcagcggttcaaggcaggccattaacaactgaagttgagcacctgttacagtaaatacatgtctggatgctgcagcaggagtgaagtaaagtccttgccctccagctgaggggaaattgcgagagtaggaaataggatgacattgaccgagagagtgtaaagtatttaaagtgtttgaacaataacaagcagtccaatttggtaggagttgagctcacttctgagagagaattgaaaggtaaggtggagatgctaagggaggtagtacaaactgagctcagagagtccagagaagcagtcaggtggggcttatcgggaaaggctttctggaagagggagcatttgggttgcactaaagaagaaaaacttgcatttgcaagtgtggagacagaacgaataaggtatttgtagaaggtggtgtgggaagtagaaaatgaggcaattaacttttggattcagttcaattctgcaaatgtaagttgagtgtttactaggagccagacatccttggtcagtataaaaatgaatttaaaaagtagtgcctatcttcaaggagcttatagttcagagcttcacagagttagaggatgcacaagtactatgggaattcaggcagggcccttggctcagactgagggtttaagggaggttctggggccctaagctggaactgtgtcttgatggatggagaggagtgagtcaagtgacgggagcacaggagcatcctgagggggtgcacccgcactgagaggatggtttggcgtgtgcacacgcctctgagagtctgggatttctagaaggtaaagtgcacgttgaccagggtctaaccgaatttgaacttcatctgaagtcaatggagagccattgaaaggtttttcatagggcaatgttatcattagatttgtgtttcagaaagatcattctggcaactttgttgggaatggacttaagagaagcaggctggtgacaggggaagcaattaggaagttattgcagtagtccaggggagtgaggataaagaccttaagcaaagcgacagggtggagaggaagggatagaatccagacctatttaggagggatatttagtggtgcctgctatgaggtaggagaagaaagtctgggatgagccccaggtttaaatgagggtagggaggtagtggggtcggtgagcagaaagactacagaaatgcagctgaaaagacccgtattacagcaaccatggaccctcagtgaattggggagggtcatcagagccagaatccacaagttttgtggactgagctggtcttcaagtgatggtgagcaattcctggaaatccctggatgaggaccaaggacttggcagtttttcaggtttaaagtaaaaaatcagtgtctggaagtggagactggaggagagaggtgtgtgtgtgtgcacatgcctgtgagatgtggttagagattatctacaacatttggcgaggaatttctgggttccagggactacagcacttctgaagtcccaggtggcagtactgcctcaccccgacagcctcctagcgtgaacatagactcaatccaattctccccatcccagagttctgcagggggttaaggaaatttccttgactccttgatttaatccaatcctcttatttcacagatgaaatacctgaggcccagagaggtgaagtgaattccccaaggtcacacagctggtcaacagtaaagccagaattgtaactctggtctctgtggacttataatgaggtgctattttcactcccccctttcctcccattcactataaacatccctcgaacattaaacattggaaatttccttgaccccttgcagaactgtgggatgggggaattagaatgtgcccattaaagccagaagccacttgtttaagggaccactgagcactgcagtacaatgtgttcagtgttccagggaccttaaccatgaatgggaactggggaggaaaatggggagtggagatggcacctgattagaagtccagagagaccacagagttatccttctggctttactactgaccagctgtgtgacctcaggagattcacttcatctctctgggcctcaggtatttcatctgtgaaataagagaattggattaaattatctcatgtagatttcttccaggtctcaaattccattattctgaaaaatgcagtcagatatttgctctaagattagtctatttgatccgtcccggtctcactatctacactttaccaaaatcctactttttctggattcttgaaaacttaagagcaggaagttcttcttcatgtctaccttcggtttctcctgcttcagcataaaccttactggggagaaaagacatctgtccactgttgctcagaacgaagttcccctcctcatacttcagtgctggctgcattgaatcaactgttctgatggtggacgtggtgcatggaggccgagaagcacatgggcagcccagtgtagttgcaaggtttgctcacactcagtgcatactcggtgccttcccctgtccccttgcctttgtgcctgtgcttatgctgttccctggaagatcttcctttccttcctgtggtctttcctgaagcaagggcagatacaagaaccctgactcccagatcctacttctagttctatcatctataatgacagatgatcagttattcttattagtggttcatggtcacacaatgaacacctatagacgacagaagtggcattattgaaataataacagtggctaatattttaaaatacttgctacatatatatttcatttagtcaacactaccagtaaccagcatgtagccgcatcaacatcaacactagagtaactcactatatttaacttcttgtttcctcctttttgtagagacatagtgaatggatacctgctctcttctcccttccactctcttccttcttccaatttaattcccctctcttgcttactcttttcctgggaaaaatgcaagagtaatttttctaaaatcttctcttcagtgggtccccatcatctacaagatgaagttcatactccttggaatgaccttggatggccaccaggccacttgccattgacttctgcctccccatcaccacacccttcttctccaggattcctgtaaatgccttcacctcctctttggttacccaaactgaaaatgacctcccttcctctcagcttccaccttctcctaatcattaaatcctgttgattctaccccttcatttatttcatacctattccatttctctttatccactgtcttagttttatatccttataatttttctccaggagcagtacagcagctccctgctgtacctaccctccctctaactactggcagagtgttctgccttatcacttctcttaactactctgataaaatccaaactcctgatccagcatataaaactctacatgatctggccccaacctacctcccttaccccatctctcttccctctcttctcttgaactctagttaatcagaaccagttgcatatgcagcagtccacaaacatacatggcccctgagcccttgctaacatttatctcctgcctggaggaactgtcccgctcccagccaacccacccaacattccccttacctgcttggtgaacacctattatatttcaaatcttagtctaagtgatatctcctctatgaagactacctgaccaccaagcttccttacttttatcattgtaccttgtattagtccattttgtgttgctataaaggaatactggaggctggataatttataaagaaaagagatttatacagggcgcggtggctcacgcctgtaatcccagcactttgggaggccaaggcaggtggatcacgacgtcaggagatcgagaccatcctggctaacacactgaaaccccatctctactaaaaatacaaaaaaaaaaaaaatagccgggcgtggtggcgggtgcctgtagtcccagcaactccagaggataaggcaggagaatggcatgaacccgggaggctgagcttgcagtgagccgagatagcgccactgcactccagcctgggcgacagagcaagattccatttcaaaaaaaaagagagagagatttatttggctcacggttctgcaggcaccaatatccactcagcttctggtgaggcctcaggaagcttttactcatggcagaaggcagagaggggagctggtgtgtcacatggcgagagagggagcaagagagagaggaggaggtgccagctcctttaaacaaccagctcatgtgtgaactaacagagagagaactcactcattaccctggggagggcaccaaatcattcatggagatctgcccccattacccaaacacctcccactaggcctacctccaacaatggggatcacatttccacacaagatttggaggggacaaacttccaaaccatatcacacctataactgcatgttgtgtttatgtgtgtaagtctgtactcacctctacgttccttgagagcaggaggcatgtgggattctacttcctgtctccatcccccagtacagcacctgacacacagtagggtgcaggtgcattaaatattgagtgggtaaatgaatgaatgacattcaagatttggcacaatctggtcagagtctagctgtcctatctttcataaacaataaaaatgcagcatcttaaggttgccatgcacaagtagcttgcaagtgtatttaaggggattatcacttttaatccttacaaccctgcccttccacaaatacccagtgactcagccacaccagactcttccccagacacaccacaggcttctctgctcatgtcctttctgttctttgtgcccagaatccctttactcccacatttcctggtttgaggcttaattttgccctttacagagacccttttcagattcaccctctcctcttttcccattgttggaattgatcattttcctcctaaacaccagagctgatgattgacctgagcctcatatttagctgaagctatttcatgtaaattcctcaaggacaaggctattccttattaatcccttattctatgggactgagcataaactctggcacatagtaggtccccaatgcttgtttgctagttagaatagaatggaattgagctgaattgattgtttaggtttcagagttcttccagtttttgctggaaccacaggacagaaggaatcaagaaagtggtggggatgggccgtgtgcagtggctcacacctgtaatcccagcactttgggaagctgaggcgggtggatcacgaggtcaggagttccagaccagcctgaccaacttggtgaaacttcatctctactaaaaataaaaaaattagccaggtgtgtggtggtgtgtgcctgtaatcctagctactcaggaggctgaggcaggagaattgcttgaagctgggaggcggggtttgcagtgagctgagatcgtgtcactgcattccagtctcggtgacagagcaagactccatctcaaaaaaaaaaaaaaaaaaaaaaaaagagaagaaaaagaaagtggtggggatgggttgagactgagggtgggtgagggcaggaccaaaggggaggctgcttaaccatgatgggatctctttcatagaagttatataaacaaaatttcttgccaacaagttgcctgtggatatttatggaaccatcatcattactattatttaattttttattatcccaaacagcatgctgagctttgagtaaagtgctgatggccaacctatgcctgtaccaggaacttgtaaggacattttctcaaaatggttctccaagccctgtccctgtcctcaaataactcacaccatcttgagatttggaaggcatcttccatgtcttctgtccaaccattcactttacagatggggaaacagggcctacagctgtgtgcctcacccacggtctccctggcagtaagtggcagagctggagttcagatccagttctgatttccagctgatacgttttgttgctcgctctactaaaacctgcctctaccaaattgtcattagaattcctcatattctatctccctcaattctgttcaattcaacaaatatttattttatcaagtacctactcctgcagagagacctgtgctgggggatgttgagacaatagagcgacagggaagatggaagttcctgatcttgacaagtttactacctacactgtgggtggaggtgggaggtgactgggcggtgcatttttattgagcacggcaccaagcatcttcagactcatttctttgggctttcttgcttcttccttttttgggccatccaccatcaatcaccattttaccatggatgaaactgggacttagtgaggctgcactggcacctgattgacactaagcacctgcacttgggactctgctgcctgccttccccctgaatgaatgagaacaaagaagcctggggttgcctagcttattcttggcccacctgaagaaggtgggagcatggaaagagattaaaccaaggaaggggaggcggcctccccagagctcctagagcctgactttcgctgtcatgattaacagctgtttgcatcttgccagctccactttctttggtccctctggccccctccactcccttctggtagaaacacgggttaagtcctttacttttgcagctctcaccaagcaggggatttgagagagatcagctggcaggtgtgggggactcgaatatgggatatctttgttaagaaacaggtgaattatgtatcagtagcctcagtttccccaacctcatgggcaagagtggcggccccacttcctgtgccctggccgatgtccaagtgccatgtcaggaatgccaacatgtcatgaatttgtgtgccttgcaaatgctttattggcatctcgtggtgttgaaagtcatgtaattatgagcagaatttatatgtcgccagggctgcctaggcgccctccctgcgtctccttccgggcactgcaaatattgaaggctggcttagaaaagaatcaaacctacccaccttgatatctatgcaccctgtagataaggttttaattgaaaatcggttcatctgttccccatgcctaattacaaggtgcctgcactgccaatggagcataaggacaggagtccagcaccctccaggaaggcctggggttgtggtcccacatggggacagcagtaactttggcagctttacctcttccgcatctaccacctgaggacttctggtttcttacccatgagcaggcactggtgtttgcagggaggacactccctcagccccatccccctccctctctggctggtgcttctgcagtgaggacaggatgcagctcactgcctgcttcctcccttctgccctgccagggatacactcctcgccccccctcatcctgccctctcctttcctttcagcccaaatgggcaaaaccagtctctgtttgtcaacaccattccctttcacctctgggcttgcctggaggccactcgccctcttccagggcgctctttccccatcctgctttgtaccctcctctcccgagaagcccctgcagtggtgatgacagatcttctgcccttgtgtctgtctcccaaggacttgcctttcgcgtcaggctggagcatccaccaccatctgcaattcctcctcacagggcagggcaaggttctgcacctggggagtgatcagcaggggtctaggggtgagggagcaggccaaagagcccccaaaggctgatgctcatgaccaggagaggcaggggtcaggttggctgtcttgcctggttggggcttaggaaaaagaggagcacccagcacctgccccaggtgtgtgcctatggccttcaccctcaaccacctctcccttggccctggtcacgtgtcactgctgtcacatttggctccaacaataattcccctgcttggagagcaggaggaagaaattcattttccagctccagccgggcggctgtgaaatatgatttctaaagtgttaataatgcatcacgtttagatagcactttacatcttccagagcagctggctgggcgggggtgctggcagcctgggcttggagctatggggctcactcctgggtttcatttctgaacttctcatgtggaacatgtgcctactccttggtgccttagtttctccttctaaaacagggaaggagtcattcagtctttgccttctgccaggatatggaggtgccatatcccagcatctttgccactcccatctccttcttccaaaccttcatttatctttttttcatcttctcctaggaggaccccagcattccttccttcgttcattcatcaaaccctaatgaagtgcctgttgtgtgccaggacctgaggtgcagagatgttactgcctttgggggctctcaggagtagatgggatagaggtgtgagtccctgcccccagcactgtggcctaacacgaagagagctgagggttgacacctccactcagctttatttggggtttggggacacgtgggatggtctctgcaggatgccagagcttccaggaaatcccagccagctctttctgttatcccagaaaggaagccctgccttgtctttggtggtctgctcagagccactaaccctttagggcccttgacttcctaagacctggaatctttctcagtcctctctcctgtgccttcatttgtgtgcaagataagtactcctgtcttttaatttgtctccagggcttttcacagacatagaatattcctctctattcatgccactgagctctttcccaccgtcacctaaaggcttgggaactgtttctccattagtcagttcatatccatagccactgcttccaggaaggcctcctaggatgatctgaggaaaagaaaagatgtgtaatatttttttggggtcgccccaggtttcccgattgctcccactcaaaaggcagttgctcttgaaatgccagagtacccaggtactccactctttgcagcagttggtcccctgaaaagtatatggaaattctgcttttgtaggtaaaataatattaatttccaagagacctggatttctagtttctagcagtcccggttctgccaccaactgtctgcagtgtctttggacctcagtgtccttatctggaaaacgaggccattgaaaaggtagtacctaggggctttctctaaccttctttgatgacactgctacttcaaacaaatccttggtgaattattaggtaaagagaagaagccctttgataagcatgtaattgccttccagttgattgatttcactgggtgagttgggggcttgcgattttctggaggggaagcttggctgtgctcagtaatgtcctcatagattgcttgtatcttcagctgcgtctgtggcctgcgggtctggtccagagtggaagctcccagagggccaggcctcgggttctgtaattctgttggcactttgtcctgcaccaccactgactcaaagctttgtggtgcctgggatgaggaagacacttccttcctgccctcagcccctctgactcctctaacttcctaggaagacaattcctcaccaagttttcccaacaggttgcgctgctgctgctgttcagctgacaccatagctgacgagttattaaaaatccttcattattattctgtgctgtctctccctcctccctccctgccctgccccaggcttccaaggcccatggctgtcactgagaaatgcctggaggcccctagccaagagctgaggcaagcttttccaccccctccctcaaagtgacccccatggatgttggcagccagccagaagcaatgggtctcacccagggttaggaattctgacacctaggtttctgatcctgctttctgcaggtctcggggagctagtgcaggtactttgcagctcaaaggtctttatagcaagaaatagttggaagccagagagggattttcagtccctcggggatcttggttagggagacatctcttaggtatgcacattgcagacgacatctgggacccgatgcttcatcccctggggagagagtgacaggccaactccatcatcccattcctgagctgggggtccaaacccagctcatccatcacccatcctgataatcagatttggctgcggcaagaacagaacataatactgagctcctctcccagacgccgcagccgacatgtcctgagagatgtggagggccttgctctttggagatgcagagagggagtggcaggacccggagggagagatccctgctcctgagttgtggggcagataggaagtgtctacagagcagttccacaccctacacagcacccttcccactgcatgtttcccatgggcacccaatagagcactcctgcaccctgtgtctgggcaagggatcccagggtcagcgctgtgggtgggaagatgttttggttctgccttccaaactggagtcctttcacttactccctgtcagatttctctctgcaggaacgtgcctcttcagatctaactcattctattgttgtctaaagcatcaagtccctttttccggagcctcacagccttggcccagccctcaaacccacgttcagccccagtttctagcacccagcctctgggacaagaataggactgtaggggagaacgctctgggtgtctgggttagagacaagggtaagcatccacaattagcttgagaattcaggggccaacatgtccaccctggcttggcctccaggttgagttgacacttttgtttgtctctacctttgtttgcctagatgaattctaactgagggccctcatctctccagaggtgggggcagaaaaaaactgggattagagttaggcgaaatgagattggggttaggaaagtggcctttaggattagggtagggaatactcacctggggtgtgggatttactagtgctcagtatgagcatcagggtaggcaggggtgggggctcaggcttgaagcagcgattactgttaaggatagaggtaaagtttggcttattatgttcttatttattcaataagcacctattgatcacttatgctgtacctggctctgaggggacttgagatgctgtgcctcttcaagagctcatgttctagttaggatttggggttagagtgattgctaggattaggtatggattggaattagtgttgaggtggacattgggttcggggttactgtttggggttagggttgaagtgggaatacgtttagattatatgtaaacatacaggttggtgtgaggtttctgtgaaagttccttcctccaagtctctgctccttaattctctcctcctactgcttacccaaccttgtctgtgctgtctaaggcttcctggacttactggaatccgtttaatgacagcgaccatctgccacccctgctggtgatcagccccttcccctttcctctctgctcctccttcgcctttcccagcagggagtctgcatcctgcattcctgggcagggttctgatgacatctgtcctctttcacagctcacattctggggatctctgacctttgcccctccttctcaatctccctgtctgtagccaccaggatgagccaatttcacccattcccaccctcgttcccttctactattgccctgcacagcttaaggccctcacacttctatctttcatgcatgggacccttctgtctttagctgagttctgcttattactctctctctcctcctttgctccctttcccatgtccttccagaagtcccctggtctcttacttcaatctgcctgttccgcctccactgagactttctgctgcgccttcctcctcctttaactcccttatgagaggactctcgacccattcctccaacagcctctgcttgcctcttgggctggagaaatttcttttcatctcccctcatcagtcatatggggcagatccctcagaattcctgctcttcctggcagcccagccaggagcaagtgattttgtaggaagagtcatttccatgcaatacaaggtattgaggaatgctggagtcggggcttgaagcagggaagtgtccttccgctctcatcttattccagggtgaaacagcatgactccggtgccgtctcctagcccagagtttagggcacatttagggggtggctggatgaaatacccaaatttcaagagtggtttgggaaggaagttccagaactacctgagcagaggttaaactgctcctgtccccaccttccatttcagagaattctgcctgtaaacccactgagggctgagtttccggaggcttccctgtgccctgctctgtcctctacctcttccttgttcttggagccctcctgtgcccccctgagaacctaaccccccatccatccatccatcagaggtttgtgagcttgattgattctgatatcaggaagcaaaggctgctcgttggaatgcatggcaccctgtccctcttgctgggagtaaatcgagagggaatattgcctggtccaggaaatgaggtgctaaatttgttgtgagataggtgtcacaagcaatcaaaacgagcctttctgcatccagccctggacaactaaatgagaaatcattaggttattgcagagaccagggacaacagaggcggagggatgagagatcccctccctattccttgggggtgggcaacacagggagatcaaaaagggaaaggaagactcagagatggagtgaaagagtgtgagagaagaggcaggctgctttctcaaggtttctcctacacctggatgtggggtatcctctttgccacagctgcatccagctcctctctaggcagttttgtgtgaagctttagtggacaccttcatcagtcacatgtttctggcctctcctctggctggcatctagggtggttctgaggctgagatgtactgacacaggacagagagacaagtgagcagagttgggtgcccccagatcagcagaatttggggtgagtagaaaagctgagacaggctcatgtgggaggctgatgagggcacagttcagggtggctggtttttgtaggatgggaaaggaaactgaatatctcctttatagcccctctgggaagactgcctggaggacggggatttgaaggttgcatagcaggctgtggatggatgtaggtctgctaggagatggtggagtggctggcatgtggacaagtaggttgctctctctttctgctaatacttgcctccttcatggaaatgagggcacagagctgccctggtgttcacatgctttggggtcccaggaacagtcatcagtgtgcatgccctaaagagaaagtttctccatgtgcccacaccacagacttgcaattggtcactaaaatcatgtcccccaccaatatcctgtaaatttctgagagtggtaagatgagtggttttggcttccctggcctctgctcttggagcatttgttttctgcctgacaaggaaactcagtcaggcagagcagggaagaacaagggctccagcgtcatcaaccctgaagttctacctctggatgctccctcctctatgcaagcctctgcctattgactgctgccatattgagacctgctcctacagctcttaattatggagcctccactccaggcttcctcagctccctgcagcaaattaacattctgtgccccctgtacgtgtagaatgaaccgagttagatggatcgattcagcagccggttggaactgcttttactttacgcagaattgatccagatgaccccaacctggggattctaggagcgcctttgcaggaaatatttttaatggagattaattggaaaactctagcatgtcctgcttatgtgcagaaagtgcctcgttctcccttttggtggctgtataccaacactagtatgttgacgtgtggtaacacactcacgcttacctagacaggtgaatgcaaacaaggacacatgtgtccccccttgcacgcagatacaaaacacactgacatcaccataggcagcctcttcctttctgattcttctcaagcctgtccccaaacattatcaggctgacacacatggccctgtgcagcttagatgtgccacagcttccactttcgtctttctgaatctggacctctttctttgtctatgtccattctctccatagcccagaagtttctggagtgcagagccagagaaatgtccagaaagagaaggcattagatttttaaagatgcctgatcatgattccaatttatttatgtgcctgaaacccagccacttccaattgctcactggacttttatgtttctgtgtcttggctcatgctgttccctttgtgtgaaatactcttctcccagttctctggctgtcgaaatatttcttgtcttcaaggctcaatgccattctggccgataaatgtgcatttattgaatacctactctgtggcaagcaagaccacctatgtccaacttacgaggctatagtaagggcccagagctataaaaggctaacatgagtctcagcccaagggaagaccagtttggaagtcagataagaaaaaaatgcaatgtatttgttcattcaacaaacatcaattaagatattcattcaacaagcatctattaaggctgtaagctcctgagtggaataagacccccatgtccatgccctcaggagtattcagattgcatgggttcccacatcattgccccccatcaagtcggccctgatttcatctcatcagcatgggctaccactgcatgacactggtagtctttcagcacttatttgttaactaatttgtctcccttgatagaatgtgatgagcaggcaacttcccattttccagcttgcccatcccatcaagcacactgtttggcttccaggagagctgtgctcaacataccagccaggctgaactgtttctaggatcctaaaaggcctcactttcccaacttcacactgctgtctatgccctctgccttcccaggacagtttcttctcccttctctctctgcttaccaggaaaactcctactcatccctcggatcttgtcaaagacatcacttcctacaggattcgttcctgcacctcaggtactttcctccatgttgccccatcatggccgctgtcgcactgtatggacttggtgcttgggtatgtctaccagacttgaagctggatgatggcaggactaggtctgtcgtgttcacctttgtattccagggtccaggacagtgtacagtatggtaggcattcaataagtatttattacatgaatagatgtatgttgaattaagtttattttctctggagggtggtgttttatacattcatccttaattcagataagcaaataataagcttttactgagcacctatggtgtgtgtggatgatgcacgactaagattacatttattgcctcaagaagtttgccatctattcgtctggaaaaggagccaaaataaaaaaagttatagctgcagactagactccaggtctgaatccatatgattatgttcaagtcccattaccaagtctttggcgtcatggttaactgccatggggaaaaggttttacttatacctttgacttccatcctagactgttttttgacctgttcttcccccttcagatggccctgtttaaagaattccttcctttaaactttgagtccaccctaattgacctgttacaaattgattatttgatgggtgtaagtccaaagtaagaagaaaatttatggtgtgtaaatagaattctaaagcatcagagttgaaaggaatcctaaatattacctagagccctccggagcattgctgccaggtggccatccagccttatcttgaacacctctagtgatgggaagcctctgctatgtgctattagaaaattttatgtgaataacaatatctattccttgggatctacaactgttaatgtctatcctagggcttgtatggaaggggcagtgatggggtctggggacacacctgtgttatgggcatgtctagtgtctgccaagccagcctttcttagaggcactagtggagagccagggagggttgatgtctacagcattcatcagagccccataccttcccgtattagttgctcacctggctcatagactcagatggttcatctggaaattccagcctctggaaggagaataatgtctaacacctaaacctgctggtctttttttttttttttttttaattttgaagtgggaaagaggggcaagagttggggggtgggaggtgaggaggcatagaaatgtaataaagcttttaaaattagaaacagagaggggtccttcagagtgcttgcctggtatcagaagatctggatttacttctggttctttggtttcagggtcaaggagagaatgccctcctcactgttgcccagctctttgtggatttctgagttgaggctgtttattcaggagactgttcctaaaagtgccaggagacctctagagagggtctgggacaagcctgcatttcttcctgggcttccagcctgttgcggggacccaggcaccattctggctcttctcagattgtgcttagaagctctgttggtaacagtggtaactaagaatgctgaagtaagcagtgggaggttttcagagcagaacttgcacttgccttaattatggagcctgtagggaggtgtcgtgcccagaggggatggctttactaaaagaagggaatagggttagactccaggaaaaattttgtgcctgcccaggaaaaggcaggatggcaagagatgaaggagtaattgacctctcttctaggaggtgaggttagagaaccccttgaggacgcctgcagaagggaggtgagctgtgagccagccttggtttgtggggagacacaaaggccctgtcctctgttgccttctgtgttacctcatatatagcccacctcattctcttctctccctccttggctaatcctttcaaagctcccttccatttcccaaagacgtcattccttttcttcaacctagaagctcaagaccttcagatgaggccagagggtgggaatcgcagcccggatttctgcctgtgagaccccactgtctctgccgcctgccctctttcccctcagctttctccagtttcttctctcttgttcttttgtccttcttattttcgttctcattttcctctcccagatggtctccttactttatttcttgattctcacttctcattttttatcaaatttcccaaccttcttttccataactcctctctcatcacctttttttttttgtttcttctttcagtgaaggagggtttccaggaagagcctcttcttgccccaccatcagtgcaggaagagtaggctttgggatgtgccctgcctctagagaggggccctctgtcattgtgaggctagtgccaaagccaccgggaatttggagacatgccaactccacatccctccctccctccctgaccctcagctccttcaaaataaagaatgttggagtggcgaccatcaaggcctttcctacctacctccagtcatcattctaattcagttctcttctcttccccttgcttgtctctctgtcctgtcctctgtttctttcataccatagtgtcctcttagcacctttcttcctcacctgaccttaaaacaatctttaacagcctcttgcttacttttcccacaactagctttctcttttatctcctttgctctctatttctgcctatgactctttcttgtcatcttttttctcttcccagtctgactttgcacattgaggcatctccttcagtgtcctgcgtctcagtttccttccctcccactgtgtggaccctgggaattgctggaaagccaagccttggaccctgcctccatgtgctcctgtaggtcagggaggcaggtgcagggcctggatggagaggacagaggctccccgtccctttctgctttcccaccccagcttctggtgcctttctccatctcttgcagccttctctggccctggcctagtttctgctctctcgcctccttcccgctctgtcttttgctctccttcctcttagcctcctatctgaactaagtccctacctgccacctgcctcctgtctcccctacctcccttcccttgcccactaaagccagattaaaattcaggttttcagcagaaccatccatcagccctaccaccccctttctgctcccacctgtctgtcatacctgctatagccaacacatttaggctccccatgccattgtccttcccataaaacattctcaggagcccttgccagggtacatttgcatagagctgtcctactaggtctggcgcaggtgccctgagctggaggttcaaatggggcaggtgggagtgtttccagcatcacttccagccttttccatgtagagctcaaagtcctgtgagtgggcctgggctggcaggtcgcttcagggatctcagctgcctgatctctatcctccttgcaccaccatgagccctaatggaagggatgtgagaaactctgatgggagcttctaatgggaaaggaaaggatggcctctcttctcctatgccggatacctcatctgggtcctcagcctctgtcttagtgacacacacccacagacctccctccacatccctgcaggatgagggaggaaacgccccagggaggaaatgccaagatgggcccaggtacactagttcctcccagcagtcggtgctgagtccttaagtgtcctcaaggtttgaccgaggccccaggtcagcaggaggcagggttgcagtctgaggacattagagatgggaaggcccttgggggccaagtgaatcttctcctcccttttacaggctaaggagcctgagacccaaataagtgaaatgagctctccaagtcacacagcaggttggtggcagagccaggaccagacaagcccacgtctcctaacttctggcttagagtacttctgtcccttcctggcaggactgtgctgggctgatcccgcttgcatttttcagggctctgttcctgcctcttgaggtgactaatccacaggcccagaacagtaagccttcttgccctgtcactgtaagcaccagccagcccctccagccagccgctgcagctggcctctgtggtctgctcagatgcaaggaaaccaggccagaccatggtcacttgtaaaatcccatctggtccctggaaagattcccctacggctgtccctaccatacccccagccttagagacggacagaagggaggcggtggccaagctgcttggatgagggaggagagattgattcttctgtccatggctttggcttcctgggatgagaaaggaccagcagtgggaaggcggtaaaggtggattcagtctgggcatttgaggctcctactgttcagtgtctttttcactgcaaactgtgaaatgaagccagagagctttggtcggcagagacaggaggtgataatagtccttaaatgtttagaaacttgtctttggggaatgccgtttgtcatttctctctcttcgtctgatgtccatatcacctgacatctacgtgtagtcattcctctgagattatccactgagagcaaggcaatggagttttctgacctctgatgcctcatctgtcaaaggagggggttaagggtctctaaagtcagtcacatcaaaatttgacattttaggattctaggctgggctgtgtataaggcaaaatcaacagacccagacccctcatccgcagtagctgggcaggcacagagctttactctggggagcctctgcctgcctccatggcccttgccaggtttctttctctggatctgtcctcaccctgcccagccccagctcagcactcccctcccttcctccctccttcttgccttctcttctcctctatcagaagtgccaatctctccctttcttctctccttcgcccttcgatggcccagcctagagaattgaaatcctctttctctgagagaacccaatgtgaggggacctctctggctgttgtatttttcatagagcaagaagggaatgactggggttggggggaaaagagtcctgcgggggtggggagagccaagatgtgagagcagagagggagggagagtggagtgtggagagatttagttccatctgaaagctgtcggtgcgaatcagaggcttccctttgaaccagcagcacgatctggagtggagagcgtggggactgctctggcccagggggttcattactgctcgtttgataaatccggggagacagggcctgtcctccaccaccccctacttctgccgcctggtcccctggcatctcatgtgcttggccccattccctctctggttccgggctggcctggcagcccaggctctgggaacatgaccatcagggcacgtgtgcagagacacggaagcagacgggcatccatgggtgcagagacaagtacttgaatgtgggaggggtgtgtgtgcgcatgtgcttgctggtaaatgcatgcgcttgtgtgttatggtacatgtgtccctataagaagtgtatgacgtacttgtgtgtgtgtgtgtgtgtgtgtgtgtgtgtgtgtgtgtgtgaatctaagcatttccagcccctctaggatagatttagaggtcacttcctagttctttgtcaaaaatgggattcgaccttgttgtcctcccggtctttgcaggagcaggaagtgtgttcacacacagagactggcctagctctggaccccagtgccctgatgaggatggagcagggagctggagaacagggatagtcgccccaggaggatcagtgttaagagggagagagtgctccaggtgaggggacagtattaaggggaggtggagaaacccctggggactggttttgcacagtgacctgaatctgagctgggaggttccaagagaagacagcagtggccaggctgctgagatggcattccaagggagccagtggcctggctccttgctgtgctctctgtccgatacttaccagctgtgtgactagacggaagtttcttgatgtccctgagccttagctttttttattaaggatagtaattgtgcctaccttattgggttgttgtgtataaaagtggcagtggattagtgagctgcacagaacagtcattggccctttataagcaggggctacttctgctggtagccactggtggcctgaaggttggtgctttatgaatcaccaaaacctctctggatgctgttgacagtcgttccagccttggctaccgctcctcccttcgtgtagggacatctagaccaagtcttctatgttggtggcagtgtgtggggcaagtcctgcgtggctataaagtgctggccagcccagagctgaagagtgcagcctcccaggaggtaaacagggttaagatgggagtgtaagctgtagggcaggaagaaggagtggtagatggcagaacttaactgatagttctcttctgggtagaggtcatgaatctcgtccattctggagagacacccgggatatccctgtagcagaaaatacctgagttcacatcccatctctgccacttaacagctgtaccttaagcaccctcagccttatttcccttttctataaaacagagataataatagtggattattatgcagaaacagtgtctacaaggcatctgcctcggtgcctggcacatagttggcatcttataattgggagtgtttattattaaggaacattgctggggttgaagggtcaaggaagataaatcaaagcatctctgttatccaggggctcccaagagtgtgggggagacagaaacacacacatatgggtaacttttaatccaaggcaggctgtgataaagtgttataaccagaggccccaacaatgcagtaagagaagagggagggaatgattcccagtctgaggctagaggggctttgccttatggggtgtgtgtggtgagggttgtgggctaacctgaaaggacggatgtctgagagagaggcagagaggatgctggtgggcgattagggttacctcacctctcaccttgcctcacctggggaagaagcacagagctgccacgccaaattccctattgctctcctaatttctccccagggtccctctgtgctcctctcacccctcaagactctgatctcctccacctaattagactattcacctgcctgcaaaccctggctgggccttctcgtaatttcctatccagtgagaaaaacggagtgtccaaccctggggcaggagatggggtgctgccagggcccccagctcccctcccacctctgtctttctcctggtctccatctctctgccttccttcccccctgctttgcctcgggtttctattactccatgggtgtctttgtctcactggctcctcctggcacttttctctctggatttctgtcggcccggcctgcgtcttttccacgctgggctctttcctacagagctcgcctcttcccttctcactctagtctcctttccctcctcgctctccctctgcctctgcgtgggtgtctgtctttgtctctgtttctcagcgttgtctacgcctctgtcagccttctgggtacgtgtgagtgcgtgtgagtatgtgtgagtgtgcgtgccctggcacacaggtatgctgctcagtttttctctgcctgtcttcacaatgactgcttaagagctcaccacagctgtgatggtgtctgaaggcagggagggagcaagatcaaagcagatgggaatacacttaaaacatacgcgcagaatctcactggctggccccagactggagctgccagaatttgacccagcaatggtctgttttcactgtatgtctgtggtcaggaccttcctggttcccctcccacctggcccccgggaggccaccttcccaccccacatagagcagtttccttgtgtttctgtttggcactggttttatttcctggaagggggcgcaggcatagggacgggattgaaatgtcatcctcagtccagggcaggctctgctctgtggcgtggatggtggacggccaggcaaccaggacctgagaggcaggtgtgcacacaaatgtgtgcctaggacacttgctaggccacttgtcctgggtttttagtggcttcttgacactcaagggcaaaccaacacctcatcccccttttacattgtaatgctactgggtcccctctccccttcctgctaactgatcagccatgccctgtccgaggcctgcacctcactgctcactttctaggctttctcctctgctctcccacatccccctcgccaccaccatatgtcagaaccgtccagagcctgtttcccttgcccttcccttctctgctccacattctctttttcagggagcttcccaggaccgactccaagttccacccagcattgttcctcctctcactgagaggagggtgctgtcctcttcacctgcccagcctgtctctacctcggtggaagtctgtgagccttctggggtcaggggcatgctctgcctccttttctggatggtggtttcacaggcaggactgtggactcggatttgctcactctcactccctcagtcaacagacatatttggaacacccgtagtgtgccaggcagcaggccctgcacctggtgatgggcttgactataagtggcacagtccagactcctggagttgcccctggggtaacagcagggatggggtggccagtgcagtgtgggccctactacagcagaagtgagacgtgagtaggaagaccttgagggaactacacgaaagtcacgggagacttcccagaggaggtgactgtttgaatcccgagggagcagggggagcagtgtccaccccagggaaaggcctgtgcaagggcatgaagaggtgacaaaggcctcctctcagtgagaggaggaacaatgctgggtggaacttggagtcggtcctgggaagctccctgaaaaagagaatgtggagcagagaagggaagggcaagggaaacaggctctggacagttctgacatgtggtggcgagggggatgtgggagagcagaggagaaagcctagaaagtgagcagtgaggtgcaggcctcggacagggcatggctgatcagttagcaggaaggaaggggagaggggacccagtagcattacaatgtaaaagggggatgaggtgttggtttgcccttgagtgtcaagaagccactaaaaacccaggacaagtggcctagcatctgggtacagatcagagagaacaggacttggtgaagggagacttggggcgttcctgtaatcataagccaggtcggcataacccaggggcatctgaactatatttgggattctatgttggctgcaggggctgttttgggaccagaaaacattgccagtggctttagtaggcccagggtctaggctgcctttccatccaattaaattcccgagatgtctttacttcccctcctttctggactctctgcaaggttattacttccatgcccctgtgtctggactgaattgcttcagtcaggcctaaatcaagaggaaacttcaaaactgccagaaagtcagataccaccttctttgtcatgttcctattcaggtttccagttgtccctctaattgtctaactgttcaggagaaataatgatcatagctgccatttagtgcatacaggcaagggactgtaccacgcatagcatacacctcatctcattttactttgacagcaatccagaaatagacattaacattccccagtttaccaggcaggaaaatgaagcttagcaaataacttggccaaggtcactgggtgagaaagccacacaggcaatatataaaccacagtctgtctcctaaacctgtcctcttagtatttgggcacagagggatttggcgttcctcagtccaggcttgtcattgtacaggtgagcaaatgggggcccatatgaggaattgacacacccaaggtcacaccactcctcatctccacaagacccccgtttcctgattcttacttcaagtgcttcccatctccatcttgccgcagggtcagctgcttcttcattccaagtggacaaggagccagctgctcactgtccttgagagacttcagcgagagaccagggtgtccaggctccatgcaggaaagccatgcgtataaattccacctctgagccagggctcaccagcaagcccactcttaagcccttgacttgggctccaggggccatgggaaggagaaacgtgagtgtggagagtttgcagcatatagctgcactagagaaatgcgcaaggatatgaataaatttgaataataatgaggacaatgcttgaattaataatgttggctgctcacctgacccacccctcccccaggatctcagcacctgccaccctgatcactcaaaagggattatcctttagaagacatgaatgaaaggtcaggtcagcagacttgaggagccactcatggagtatgggagagggagcctgtttctaacttcctggcccctgcagacccaaagacctaaatttgcacacttaatcaagagtaaagagtctgcctcatgctagatcacattctggttatcagtccactctaggccccagctacctctttttcagacccctttgtgtgcaacaaccagtggggatggatgtcggatgttcaggagattcagatgggggagagagcttggccctctgccttagaggagatgttggcattctgctggaacagatagggcaaatgtcctcacctactagttgccctctaccctgtgacaaacaaaatcatggacattacccctgatcatttgagagaggaaaccccgtacatagtgataacagcagggccgagtgacgcgaccggttatatttgcccaagaggccaaggaattgggctaggagggcttcctggaagagggacatgtagagcaggtttgaggaaaaaaggagaaatggggctggtgaagagaaaggaaggaaggggatgagactaggatcccacttctgtggtggcttagagggacatcttggagtggcgaggggtgagttaagtttgcttacacacaggagtgatgatggggcagataaattttagaaagctctgttaggaaaaggtcagatttggggattgtggcctctgcagattcatgagctgtggagggaaagaagaaggaggaggccgtgacttttggggagagccgatttcagttacctggtatgacaggttgggagcatggcaaggaagtcccagaactctcctttgctgtccttcagtcactcccttgtcccccttctcctttccccacaacttggcaaaggaacctgagccccatagctcacatagctctgcaaggagcctaggcctgccccaccactggggccgaccagtgctggttggagccagtgggtgggagtggtgggggagaaaaaacccgcaatgcaattccctgctccatttaggctccacaattaaaggcaattactctgcagttctctaatcaaatgctcccggccgagctgccagccgggcagccatgtgtagctcccacagccggagggagagtggaacaaagtcacgtggcctctcagctcccacagtgaaggaggcggggtgtgtgcaggtgtgttcatgtgtacacacttaggcccccctgcacttgggagcgaaggatgaacacacagagcagggcacatgtgccaagaagtgggttcagagctactttgttttggatacactttccacccaggaagcttctatacacacatgtggacatgctggctttatagtatctaccctgatgtattcgtggaggaattgtacctggcatagttgcacatgagtgttggttcacattgactcccatcagctcacatgacacgcgtctaagtaggagtcattaatgtgggggtgggctggggcaatgggtagtagaggaacagctaggacctggatgcaggggctcaggttctaatcccagctctgccattaacttgcccttgagtaagttactgtcctccctggaagtcagggtcctcctctgtaaaatgagagggttggactagacccatttttaaggcccttctgtaacagtgcactattttctgtgattgctgagcacttcagctcctgaaatccattcccatgggtctcagagggaggaaggaataaagggtaaggacgtggcatcttgaaacaaaggggttgaggctgaaggggggcagggaccggagagtccccatccccaactggaggctctccctccttccagctgcatggtgagggggacctcttagaggagcccctctccttactcatcttacccagtgctggctttggctttgcagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaaggtgagtgcctggctacccaacgtccaaactgtcccatcttctccgccattccccacttccagcatagattcctggactcaccatcccttagttccctcaccaccctcctctgtgccacagcctcccctctgtctctgctactgagctccatttctacagctttcccaccctgcagctctacctttcctcccactgaggactgacttgaggaaggcagtacgaagcctgagaggtcaagggaaaccaagagacctttatataagagagtttcaggcagacacagaccctgtgaggggagctgcaggcagacagctgtctagcaggaggtgctgggagactccagagtctgcagcaagggtaggagagggcacaggcaacttctgtgtcccgcaagtgtctcatgccggcctggctcggctccagcctctctcctccccgctgcccaggcgatgtctgctcagaggccaaaaactcattttaatatcagcctgagcattcatttatttattcattcaacaagcctttattaagcactggctatgtagctggtgctgaagcaaacataatgagtcagtcaaacacaaaaaaaccaacttcctatattctaaagcaagtaaagagacctttggaaaggctgcctggcagagtggacacctgggttctagtcctgcctccgccagctgggtgaccttaggaaagccacttcacctctctggaccttcatttactgtgtgaagcaggcatagtggttgcaggccggtctgccttagaagtgcatttgtgagttttgagccaaatgggagaagagatttgtaaaaacatattttagctttaaagcactgtaaagaagtaagtatgggtgtgggggatgggctgtatatttttattcttataattgttgagggagttgagattatttgctgtgagttccatgtgttagtacaggtagaggaaattcgtctgtgtagagcaatccatataagggaaagagatgggtctggtagatctattgatgatagaaagagaaagaaactgggagagagagtgagatcaatagatatggagtgagaagaatcgatagcctctggacagagggagatcatgggaaggagctgatggtgggaatgtgaggggaggctgggaagcaagaagcgggtgggggagcctggaggaaggagggcaaggcccactgcctcagccactgcttctgcaggaaaccaggactctttggtttaggagctcctctggggagccagcggtcccctgcctcatccttcctccctgggcctgccttgggcttccctctgccttatgagtcctgcagaggtgctcccatgagctcatgtctgtgctgcgatgccctatatttcctggcgcccacacactcgctctccctctctccccctctcctttgctccctgctgtgtgcctttttctctcctctttctcccctattattatgagaggcatttgtctgcaaacagccttggagatttcatctgctcctgctagcctccctgcttcagctgccctcctgtctgctcctccagctgtatggctcccagcctcgccgtgaggtgtcgtggcatcaggtgtctgtgtctggggcctcaccttctcacctgtcagtggtgtcccaggagagggcagagggaggagtactggtgtgggatggctgaggatgtgtccttgtttcaaggttgggcctcattctttctgtttctgcagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcagtaaggaccccaatacccttcagtacttcgaggccctgtctctctgtatcctggcagtctctcccactctccagttccctctttaatttcccagcttctccctctctgttactggccttatccctgccctaatgctcaagtccaggtagaagaaagtaaaccaggcatgtgggagacgtggggtgctggcgggacgtgagctgtgtgaggcccagcatcctctctgccgcagccagtgcctcggccactcagggacagggccttctgccttttagaaacaaggctgtggagacaagaagcagggacgtatggagtgatggagacccgggccctcctttcccagctgtcctggctggcaggcttgttggtgagggggcgtctcccttccactttcctctcagctgcctcggagaccccaaacggcccccgtgcccctccttccacctcaccctagcctcacacaacccttcttccctcagctgcctcctttcctccctcagtgctcacccttcctctcaaattcacctgggggcctcctccaggaacaggggaataggactggaaggaatgggccttgaggctgaaaactggggtgaggggtgggagggatggggtcctgctgtgtctggatggctgctggctcttggaagccctgcagctcttggaagccctgcgccagccaggcagccacccactgggggaccgagcagatgtccctctatggtaacccccgaggccatttgcataatgaggggactctctcctgcagcagtgccacagaaccggaaggaggccagcttcagcacaccccttgccccccctcacccactcagcccccagcctctctccaagcctcactcttgcaatacctctgaatctgccagtcttcctgttctctccagccctgttgtctcactgggcctctgcctctgttgtgctttctgtcttgggcttggactctgtccatctgtgactctctttcttccctatttacattgactctgtcccttttttttctgcctccatttgatatgttttgcccctcttcctttccttccttctaacttgaaatcactgaatttgcggggagcccccaagatggatgggagaaaggagagaggagctgagatgagggagtttgggtacaaggaaggttttctgttgtttgtttggttggttggttgattggttggtgttttttgagacagagtctctgtcacccaggctggagtgcagtggcatgatctcggctcactgtaatctccacctcccgggttcaagggattcttgtgcctaagcctcctgagtggctgagattacaggtgcccgccaccatgcctggttaatttttgtattttttagtagagacggtgtttcaccatgttggccaggctggtctcgaaatccttacctcaggtgatccactcatcttggcctcccaaagttctgggattacaggcatgggccactgtgcccagcctgttgttttgttttttgtttttgcaaggagggaggtgagaacataacaagtcctcagagcatagtggaaagagagagtcctagactgctggtggttaggagacctgggcactttggccattttggcatcatgatcctaaagaggtgacaacctctgggcatgagttttctcatcagtaacatggcataatgacaccagccttttcttagcaactgctgctttgcttcatggagacttgtaaactgtgaaggtctgggcgaatgtgagatgtcagaataagtgaggactggagggacccaacagccaatttcattggatgtaaaggccctgaaggaccaggattcaaggctgctggatgatttgcttttcctctctaggactaaaatggaaagaattagcaaggagcaggaatgaggttagacagcaaaaattagacggtgatcttgaatgccaagacatcatctttcatccctcactgaggtgtgtcagccccatgctcaaccaagtattccgaggaaccgtgagactcttaggaaaccttcttctttcttttttcctccctaactgcctctatcttaggccctagaaggtgctactgctgccctggagtactcgcttcctaatgagtggaccttgatactcttctttctgctaccttatcacagagatagagagagatgaagaaaggccagctaagctactaagtgttgcagtaacaatgtcttataatggcacccagtggcttggttcaatccaggaagaacctggaaaaggagaatatcaaggggaaccctagatggaagagtgccttgtttaaaagcttgcaggccaatgaaggagagctacatagcaggagagccgactggcttgtttcgagggcatggtgggtattgaaggtatggtccttgctggcctgcctgggtgacttgggtggatgagagaacagggagagaccccaggagtaactttaagctgaaagagagacagggacggttagtgcagctggaggggctttacacgcctgggcaaacacctgggcatggtgtctcctcggggctctacccatccaggatcttcctcccgggtgtggcagcaacatgtgaccttagaggggcctgagcagaccaggaggcccttctcccttcactctttcctctccttgtctttctcttaaattctcaaacaccctgccacctgcagcacacggaggcaataagaaggcatgacacttcctgcatcccttcctgcgtacctgcttacccacagcctttgctcatggcagctgggggacccagagactaggcagggcagaaatgaggagtgggctgtgcccagtgcctggtatcagcctccctgcatgatgtcagccttatagactcctctcctccccagccatccccctcagcagccccccagctccccaggccaggggccctcttcacaaaatggcctctgtcattcttccttagggtaggactttgaaaagaagcctcccactcccccgcagatgcagacataacatagatatacagacctccaaaaccatggtgatgagcatgacttctgggtcaggcaagcctggtccacatcctagctctgccctctaactcactctcctgtctctgagcacatttgtttatcctcttcgagcctccgttccttatctgtaaattggggttaatatatttaccatgaaaggaataatgaaatatactttgtggtagggattaaatgaagtcatatacaggaggcactttggctgacacaaggtgaacgttcactgagtggcagaagttattgtcgatcccaccaccatttacagttggcttcaccttcttgattttgttttgcaaaatcaggggagtaggtgtccattgtatttttgaagttttataaacaaggagactgaggcttttttgaccacagactcaggggcacatgagtttggggaggcacatgagcatattgatatacagatttaagtcacaaaccataaaaacttgcttataaacacatgcacacatggacacatgccctttaacagctggctcagcaggcaccttaacagctttattgtcatttgtcccatatatgagggacgagctcatatatgagggatgagctcacggaggatgggcagagagtttggaaaattcagagaaaggtagactgctggcagaggtgacagatgggtagtctttgcatgaacaaaggggcaggaggcattcccagggtagaggaagctgatgccttcccagcggaggggcttcacacacccgggcacacacctgggcatgttgtctgctcggggctctgcccatccaggatcttcctcctgggtgtggcagcaacatgtgactttagaggggcctgagcagaccaggaggccctgagcagcagctctttattcatttctctccacctttctctacttttcaagctgctccccatccccatcctcaaacctgtccccatctggcattggaaccagatacaccacagaacaaggaggaagagccagggattcagaggataattagccaggcaggagttggagccactgctactctcgtccaggcagtaaggctaatacattccatacctcacacatgccctgcacatcatagtctatgtatagtatctcatctgaccttcatgaggctctagtgagtatggttatgtcttggtttcttctctgatgaagaaactgagactcagtgattttaggaactcatccgagatcacacagcaggtaaacaaaggtgccaggatttgaaaccaggcagtctgaatctaagttttattctttttccactataccactaggcacacatgagttgaacagaatgctaagacaggtttcgagtagtttctactggaaaccccagcatagagaccttcattgtgtaaattctagaacagccctgtccaccactgggcaccgtgggtctcccaagatctcctcttgagtgttccctctgcacactcctctcgagtgttccctctggaccctcctctgggtctttcttgtctttcccagaaagaagcaaacaaaatcttttatcggtggagcacgctggctcatgcttgtaatcccagcactttgggaagctgaggtaggaggactgcttgagcccaggagtttcagaccagcctgggcaacatagcgaaacctcgtctctacaaaaaatagaaattagccaagcatgatggtgtgtacctgtagtttctgatacttgggaagccgaggtgggaggattgcttgagcccaggagttcctttctcatttatggttgatgaacactggggggaccagaaaaattataatcaaaatccttctgcctttatttcatcagtatccattcattaattcagcaaatatccctgagcacctgtgatcacccaagccctgggctagacattgaagtgttgatggtatatcagaagcagccgctaccctcagggaacttacagtctggtttgtcttagaagcctatggagataggggagggagagccccccttgtttgcaacatcatacatcggtcaattgaattctttaaacatttagcaagagcctacttggtcacattctaggcactggtgaccatataaatattagtgagacagggttgctgtttttccaggggatcacagttttggttggggcagggttcgataactgttataagtaaacaaaatccaaggcgctaagagctctgagtgactggtgggggccaccatggtgggggtgggctacagcatggaaagccttgtgcatcaactgggatttgaacaggataggaagcacttcaatagaagctgtgggagaagggcatgccatatggaaagcactgcaatgcaggtcttggcttgaggaccctgaacaggaggccgaaatgcttggaacttatgccctaggcagttgtagccattgaaggtgcttgagcaggggagtggcacatacttagctgtgctgaagggaaaaataacctgctagcagtgtgacatggaggttactgtaataggccagcccatctgtctgctccagggcagaggagcagacaggaggaaggatgggagaagtgctatggaggtagccacctttccgagccagactcccaagactatgagctgtactcagggcctgagatagcccagccctttcttaagtttgaggcttccatctgtagtgtgcagctctgagcaactgtaggggtatggagccaggcacagtggttcacgcctgtaatcccagcactttgggaggctgaggcaggtggatcacctgagaggtcaggagttcgagaccagtctggccaacatggtgaaacccctactctctactaaaaatacaaaaattagctgggagcagtggtgggcgcctataatcccagctacttgggaggctggggcaggagaatcgcttgaacccaggaggtggaggttacagtgagctgagatggcaccactgcactccagcctgggcgacagagtgacactccatctcaaaaacaaacaaacaaacaaacaataaaccagtaggggcatggagtaccagaaaatattataggccaggaaagaaaagcagacaaggactgggaaagatgtgtgagctgaggacctagaggaagccaccacaagagcaatgaagacagtggttgtagattagggggtagggtggtaccgcctacctagaggcgcacatgcaggtggaaggatgcttccagaggcaggagttttggtcttcagggaagtgttagccacaccctgcactgactttgctctgctttctcccacagtccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggtgagctccagccagctcccccagctcctcctgggcctagcccagctcacctctcctttcccacaggggtttcaccacagactcaggagcacacagacatgagaggggtcttagaggtcatctggttcaaccctctcattctacagttgggaaaattgaaacccagagaagagaaatgaattcctaggtttactgtgtcattcagtagctgaacagagactaatagtaataataagttgccatggattaagcacctactgtgtgccagacaccgtgcatgctaaacactttatggacagtctctcttaatcttcataggagtcccataaaggaggcattatttccaactcacaaaggaggaaacttgcgctcagagaggttgagtgacttgtccaaggtcacacagctggcacagagcgggggtttgtacctgggtctgactgtgctttctctccactgatcacttctacctctttccttcagcgtctggttgtcagattattccagtcatcacaacaaagaggctggggaagcagagatccttgtatacattttatagatgaggaagccatgaaagatatcaagtgacttgcccaggattacatagcaaagcggacagtacagctggaattcaaagccagatttcctggttggggttaccctgccagttgtgggtaaacatatgtgtattcagccctttgctggtgctgcaggagcacttctcagtgtggagacagagatgttcccatgctcctcagcaagcaatcccaggaatacctggcttctggcttcagttctgcccttaacacactgtgtgaccttggataattcgcttcacttttttctggccttagtttctcatttgacaaatgataattcagcctcagtggtacttaaccttttcacaaccaaaaactgtgatttttcttcatcagggctacatgtttttagatattttggcaaccaaacaagttggtttgttaatatccatttgtcatctacccccatttttcatattcattaaagacaatggagcttcaaagcagcacaagggagccagtgttattgcactggccctcaactgggcctgtccagcaaagctgcatgcatggtggtcaaacaacggggtcttactttgattaataatatggcttccctcaggcagtttgcaatatagaaaacagatcaagggttcctgtgaccatatttagggacccctggctgtcactgagcaagtgtaagacttcgagcctgtgagtcccttccctgccctcaaggagtttacagtttagcagaagaaacccaaccctgaaacacgcacacatggtgcctacaagcaaggttggatgtgtctagagctgtgagcaggacacactgactataagggcataaattcagtctgggagagagttctgagggctgggctggctgaagaaggctttccagaagagaagggatttgcgctggactcacaaagagtgaactctaatataaactgtggccttaataataatatattagtttcggtccatcagttgtaacagacttatcactctaatgcaaggtgttaaggtgttagtaatgggggaaagtgtaaggtcggggaggagggtatatggaaactccctgtactttctgctcaatttttctgtaaacttaaaactgctccaaaagatagtctgtgatgtgggcatgatggcacactcctgtagtcgctgctactcagaaggctcaggcaggaggattgcttgagtccaagctttggaggccagcctgggcaacatagcaagaccctaaaaatatataacttttaattaaaagataattagtagtctattgattaaacacacacacacacacacacacacacaagggaagaggttgtgggagtgaaggggattgagctttaagttaaagtacccctccagcccaagcccatctctgagtgaggtcaacttaagagcagaggagggggcttttagcttaaccatatctcccacccttgtcatgttccaggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccgtgagtgggctggggggagcagtctggagcaggggggtggaagaaggggtgtgtttgagaagcacactcttagtttgagaaacacaaactaagagtccccctatggtccccaggacaaacgcttgccttcttcacatctttcattccctggattgaaccatggggactaagggctggtagagcattggctgtggagtcaggcagtccccaggtctaaaccagcctgttattagtcaatggtttacactctctgggcctcggtttccagttctgtatactgtatattgcaaaagataaaatactggcctacagtcccttattcaaactaaaagtggttcgatggtgcagcctgaaccaaggctcttcatagtcttttatttaatttagtcttaagtttcactgcagatgtattcatatgtgtgactatgggatgtggcccagatgctgctggggatcttacacagtaaacgctctatgcacaaccattgcctttctaaatgtgaaaaattctaaattctgaaatgcatctagtcctaagggtttcaaataagggattgtggacctggacctgcttcctggggttgtgagcattaaatgagatatagcagaagagcatctagcatggagtattcttacctggtaggtgtgtaataaattgtctctccccagggaaccatgggggtgtgggcagcaactggggatgcccacaccccatcctttttagtgagccaagcaagctcacactgacgcctagtggccacagtgggtcattagtccattgagttatttgtccctttggtgccttcattggtggtcaccctagcaggccccctagaggctccatgtgcaaaaggtgaggaagacagtgtgttaactggagccgatacactgcaacctcaaattcctagatccccgccagagtggtcaggtctgaatgtacgtgttagggagggaaaaagaaactcaagggacagaaaagaccctgactccctgtgctctactttgcagaccctcctacagtgaccctgtccattgagccacagacggtgcaggagggtgagcgtgttgtctttacctgccaggccacagccaaccccgagatcttgggctacaggtgagggggtcagaggctgggagcgctctggggagtgataaggaagagttcggggttagaggctgtactggggaggccaggtgtcatggatgtagttgagagggtctgaggcctgatcccacctctgtgttgcctcctcccctaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactgtgagtagctgggagggcagggacggggacagagagcaggggcccccaaagggccttggacagagtcggggactgctccatgaatggggaggtagcagggcaggaggaagattgattggagttaaccccatgagcttgagaccctaacgagtggcttctttctccctcacagttgctccccggattgtagttgaccccaaacccacaaccacagacattggctctgatgtgacccttacctgtgtctgggttgggaatccccccctcactctcacctggaccaaaaaggactcaaatatggtaagactcttactgcctgttcttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccttactgcgtgttctgaatgctgggaggaaggggtgcggccacagatgggagtagatggggggctgcagcattatctttgaacctgggctatttctagggtcttgggatttggaggagaaagtgcttacggttatccccacatcttctcacaggaaagcccagttcagaagcactggggggacaaactcacctgtgcacgggaagcagggtggggtgggaggaagggagagggcctggggcgggcctactgcagtggtaaaggtctggtaaataatgctgcacagggaggtggggaagctgaggcgattcactaaagaaggctggagtctacagctctgcagagacccccattagaccatttgggccagaactacaggaagaagaatttcagagtaaaacgtcctatgtcatttggcaatgaaaacactagaacagatcatcagaagaggctgcgtcctcctaaaatgattgcagccttcacctgccctctctggcctccaccccatccctgcccacacctgcagagatggtgtgtttacgtgccaacctgtgtagagtcagagcatggaccaaaatggactcgggaaccccatttcccttctgggaattcacttgtggcccttcctgctttctttccgatgcctccgatgtggggccctcatggacctaggggcccaggcctcctggctccccacccgaggctgctctctctgcccaggtcctgagtaacagcaaccagctgctgctgaagtcggtgactcaggcagacgctggcacctacacctgccgggccatcgtgcctcgaatcggagtggctgagcgggaggtgccgctctatgtgaacggtgagtgagtggcctgagaggcagccgggcctgggcgggctggtactgcagtttttaactggttctgacttgtgtcttcttgcttgcagggccccccatcatctccagtgaggcagtgcagtatgctgtgaggggtgacggtggcaaggtggagtgtttcattgggagcacaccacccccagaccgcatagtgagtggcggacctgcctgcggacagccagccctccctgcttctttgcccaggcccagcctcctctcacttctgctggttttgctccttcaacttccctgtcccgtttccatcctcgaatcttctgctttctgtccctctgtccctttacctgctcaaatcccacctcctcccttacttgttatgtgtccctgagcagatcacttaatgttttgaacctcggtttattcatctataaaacagggccagtaactcctacctaatagggttgctgtgagaagtcatggcagcaacaggtgtgagatgcctaggccagcacttgattcatgttagttccccactctctcccctgggctaacacttcccctcttttctccctcatctgcctgtcattgacctcctgctcttttctttgctccctccccttccctgtctcctcctctggctcttgccatctctctcccttcccatcagttctcctacctgcctggcccactcttctctccctcctcctgccttcctcctaccagccccttgccttgccactctcctccctcctttctcctctcccccacaccatgagccattaattccttccgtgactattaactgtcaaacccctcatcacatttaatgaccatttggctaactccagggctgcccagggacacttcattaccacggccgcccgggcagcaggcggctggcctcccggggggctttccttgcagatctaggaggattgatccctggaaaggagccagttctcggctgctccccctcccttaggctccactctgaggaaggggccactcaggggaatggtccggctgagaagtcagggatggaggggtccaggaataccccgttgtgggttctgcctattataagtctgtggatcagtctcagagccagccaggcaggtcgtgtgggttggttaaaggtacgcctaaagattgagttatgcttagttagaatcacagactatcagagctggaagaaatcttgagcattgtctagccctagcctggttctgtcattgtatagatgaagaaaataaggcctagaaagggacagggaggccacacaggggcttgatggggagaggagcccagcgttcttgaggacaaatgcagaactttttctacaacatctgggaggattcccagtgtcggttcaatggatccgctgcatccacatcacatgggatcatgatgaaaatagagattctcctcctccctggagattcctatttaggacataagtcccaaatatctacatttgaaagaatctccctaggtaaatctgatgtcagccatgcttgggagccactgcttctccttgagtggagtgtcagtgccgagggtgtgaggtagcaggtgtgacttaggtttgttacagggaggtgttaggctgggcttgtggggcacacatggcacataggggtgagggtgccttgagggtggatcaggggacacgtgggcatgggcttctgccccctgcccctttcttaccttcttccttccctctccaccacaggcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgaggtgactggtagtgctgcctgccagctggggtgcagagcagcctgaggattctgctccttcttttctccaggggcagggctcagctgctccccttcccttgggctctgctctgagggaggggacacacagagggatgtcctggctgagaggtcaggagtgaaggggtttggggctactcccctctgattcctgcctattgtaagagtctgtgcatcagagggaaagaactctctggggccttccctccagaacctggcctccatgctcaactggggaaatgccctcacttcgttaaagtgtactgagcatttgctatgtgccaggctctgccccaggggctgcagaaagagctgtgaacaagacacagtccctgacctcaagaaactttcggtgtagtggaggagggacttacagagtggtagtaaattaattcggatggagaagaatcatatgaactgcaaaagggaataacacgcccatctcattgggtggacgtgaggattaaattagagaatatttacaaaatgcctggcatacaataggtgttcagtaagtatgggttcccctacctcttcaagaattgtcactctgatagcagaaaagtgttctctcctttaaggcacttctcacatgataaaagaggtattcctttgacttttttggaagctaccaagtccaaggaggaaaagatagcatttttttgttgttgttttattttttgagaactaaccatttgacataggagatggagaaccacatggaaaatgacagcatcccatcacttcagtcttttttttttttttttttttgagatggagtcttgctctgtcgcccaggctggagtgcagtggtgcgatcttggctcattgcaacctgtgccttccgggttcaaatgagtctcctacctcaacctcccgagtagctgggactacaggcacccgccactacgcccggctaattttttgtatttttagtggagacgggttttcaccgtgttagccaagatggtctcgatctcctgacctcatgattcacccacctcggcctcccaaagtgctgggattacaggcatgagccaccatgcccggcctatcacttcagtcttaactaaggatgccagcaagggggttgggggtggggaagaatggagtagatacagtaacgtggggctccacagggaaagatctcagaggggaagagctataagcaggatctggattcaactagggctgctaggaagacagagaaggctggaagcaggattcctgagctcttcctcagctctgggaagcagaggaaaccaaggaaaactgttggagccctgagtagataggtgaacattcggcagtcacagtggtattatggatggcacagtggtgaaagatgtcggaacacgggtggcagattggagagtttggagacagctgacctcaaagaagagcgaggggccaagcatcatagtcaggtgggctgaaggacagggatcgacagacaaccaagaccaggggcaaactcctgccccagctgcagggatgagacatgaccatgatctccattctgatggagctggagcacagaccaaaatccaaccacaatgcagaccttcctctctaatccaaccttgacttaaacctaacactgtccccaggctcagtcaaaacttagccctgtacacaagccaaggttgcctctgtggctgtggcctagcctttagccagcactgagcttagctcccagtataactccagcctcacccctccacctttccttccccatcgaaagaggtgttacctgtgggcatcatagctggggccaccatcggcgcgagcatcctgctcatcttcttcttcatcgccttggtattcttcctctaccggcgccgcaaaggcagtgagtatgggccctgtgcagcccacagccttcccctggctcttccagggccatgacaggcagtgcttggggtggatgggaggttggcccttgagctccagcccagagggagccagaagcagccgctgcagagaccagcaggaagcacttgttccaggctgcctctcccgtcccaggtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcggtgagggtcctgctcctctctggcctcctgccttctccaccctctgaggaccagctccatcccagatctctaataaccgcggtcattctctccttcctcagtcggtcttccctggtcctgccacacacactctcccacactcacacacattctctcacacacgccccaggctagtttcctccagcagaggataggcagctgggattgtccaaagacttcctttgccccacagtgtgtgaaagttggaagcccccagaggctttctggtccatctgcctcattgctgagatgaggaaacagccctggagaggggcagtgacatatacaaggtcacattacatgttagcaaccaaactagtgctcgaaccaaggtctctggcctcttcccaccacatcccagagcctctgctgagaggaccagaactcaagtctgcccttgacctcagaccccacccatgagcaggtggcctctgagcgtggggaggggttggtgaggggcgaaaagagcagggcttccgtctgctgacgtcccactcctgctgctccacagtcgtttaaggatgatgtggatctgaagcaggacctgcgctgcgacaccatcgacacccgggaggagtatgagatgaaggtgggaaagggggaaggggccagggcatgagggctggtgggccagtgggtttctgaggtcctgtagcggggaggtgaggtgaggacagacttggggaggagtggttgggagggtttttgaaggagcagaggaggtggaatgctagatggggacatagggagagctggaggaagaggcccagaaagccatggtgagacttgatccccacccaagagggaacactgcctccatcctcttctctcattgcccccaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaa

SEQ ID NO: 176 - DNA, 19540 bp, Homo sapiens; identical to SEQ ID NO: 163

SEQ ID NO: 177 - DNA, 131880 bp, Homo sapiens
aaaacatctatcttgctgtgtttggacaggccagcccctgaaacatcttgggcaatggagggttaacttctcaaagtttaataggcaagaccagcaaccatgcaacaaggtaaattgtcctcacgagaactccaaagactatttttctctctctttttttgaggcagggtctcgctatgttacccaggctgctctcgaactcttgggctcaagcaatccccccatcttaacctccccagcagctgggactacagccacgcgccactgcacccagctgacttttccttctaagcatctttggctgggcgtggtggctcatgcctgtaatccctgcactttgggaggccaaggtgggtagatcactggaggtcaggagttctagaccagcctggccaacatggtgaaacctcatctctactaaaaatacaaaaaaattagctgggcatggtggcaggtgcctgtaatcctagctactcgggaggctgaagcaggagaattgcttgaacccaggaggtagaggttgcagtgacccaagattgtgccactgcactccagcctgggtacacagcgagtctgtctaaaaaagaaaaaaaaaaaaggaagagagagcatctttatcttcattttctaacctttaagtgttactttctcccagtaacattttgcccagaaagaggtgatgaatatagatttaagaataagattttccccatgttgctgcctttccagaacaagtgagttcattctcatttgtctttcttcagaaatcttttatctgtctttctcccattagctggaatgggtgctccatgagaataaagacttgggttccattcttcctattgtccccagagcctacatactggctggcattgagtagcaattgaacagttttctgaatgaatgaatgaatgaatgctcaaataagcacatgaattaattatcactttcctttgaatctctccattcttcttcctcacccaatggggctcgatccttatacacagaagatactctataaatgatgattcaatgaatgccaagccctgttctatgcactgaagaccaaaagaaataaaagacatcattcctgctctgtaagaattcataggctagtaaggaaagaaagatatataaatatctgtaatacaacatggtaaacaggaacaaggtgacgactgttcctgaccatttcctgtatcctttagatcaggaactctcaacctttgtgcacgtgtatgtgtgtgtgcatgtaccatgtaccccttggacaatcaagaatacaagaaaccttgtattctttctcagaataatgtttttaaatgcataaaatacacaggattataagggaaattaatggcatgaattacatttattaaaatgttaaagtggcaccatggtaatacatgcatgtatttattaatgcattattcagcaagatccagcaggaacctaataacaatgacaattttgaagtctttttttttttttttttgagatggagtctcgctctgttgcccaggctgaagtgcagtggcgcaatctcggctcaccacaagctctgcctcctgggttcatgccattctcctgcctcaagcctcctgagtagctgggactacaggtgcctcccaccacgcccggctaattttttgcatttttattagagatggggtttcaccatgttagccaggatagtctcaatctcctgatctcgtgatccaccctccttggcctcccaaaatgctgggattacaggcatgagccactgcacccggcctgacaattttgaagtcctgatgagtgtaaacactactttgagacatttgcaacaacagcatagatatgaatatatctgtgatttctctttttttttcttttttttgagatggagttttgctctgttgcccaggctggagtgtagtggcacaatctcagctcactgaaacctccaccccctgggttcagtcaattctcctgcctcagcctcccgagtagctgggattacaggcacctgccaccatggccagctaatttttgtatttttggtagagacggggttttgccatgttggccaagctggtctcaaactcctggcctcaggtgatccgcctgccttggcctccaaaagtgctgggattataggcgtgaaccactgcgcctgacccaatatatttgtgatttccactggagacaaagtcacagatgctgctagcactagtgggtttgttgcccacattcagaattaaaggaaatgctaaatttcagttacagactatcagaaattaatttgtatttttttcccacagaagcttacggatatcaccttctacctgaagggtctctgatgcccaggttattaatctctgatcagaatgttctaatggagctggcacttatttagagacagatcttagatggcagatctaagcaattttagcattccttgtagtacagcactgatggtagtaaattcacgcaacttttgtttgtctgaaaatgtctttttacccttccttttttaagaatacacaatacacagttctagtttggtacttttttcctccagtattttaagaatgtcatttcattttcttctggcttccataatttattttgggaagtcagttataattcttattactgtttttctgcaagtttttttttttttcccctttctagctgtttgtaagggtttctctttctctttagtttccaacagtcatttaactataatgtgcttggatgtgtttttgttttagtgcatgtgttctttttttttctttttttaaatttatcttgcttgggctttgctaagatcttcttgaatctgtgggttaatatctttcattgtttttttgaaaattcttgttttatgactcattatttctcctctttccttctgaaattccaatatgcaaacattagagcatttcatcctgtcttacatctctttcaagttctgttccagtttttttgccattttttttttctctgtgcttccgtttgcataattccttttctttcttttttaccttttttttttttttttgagatggagtctcactctgtcagccaggctggagtgcagtagtgcaatctcagctcactgaaatttccgcctcttgggttcaagcaattctcctgcctcagcctcccaagcacctgggttacaggtgcccgccaccatgcccagctaacttttgtatttttatttatttattcatttatttatttgagatggagtctcactctgtaacacaggctggagtgcagtggcgtgatcttggctaactgcaggctccacctccggaattcatgccattctcctgcctcagactcccaagtagctgggactacaggcgcccgtcaccacacccagataatttttttgtatttttagtagagatggagtttcaccgtgtcagccaggatggtctccatctcctgacatcatgatccgcccacctcggcctcccaaagtgctaggattacaggcatgagccaccgctcccagcctaacttttgtatttttagtagagatggggtttcaccatgttggccaggctggtgtcgaactcctgacctcaggtgatccccctgtcttggcctcccaaagcgctgggattacaggcatgagccactgcgcccagccagtttgcataatctccaataactagtcttcaagttcagtgacagattttttttctgctgtggccaacctgctcttaagcctagccaatgaattcttaatttaaaacattatatttttcaattgtagaatatccatgtccttttttagagatttaatttctctattgacattatttatcttttcgtccattttttctaacttttcttttatttttctttaacataattacaaaaatcatcttaaagtccttgtctgctaattccaacatctgggttacctgtaggactgtttgtgttgtctattttttctcttgcttacaggccacatttttctacttctttgcatttttttttaatattaagcataaatagccatagagtctgatgtagatattatttttcaccagaaagagaacactctttcttctctcaggcagctaaggtgatggactgatcactttgatccagtctgatattgagctggatcagttcacttttcgtttcaaatatcagctgagcatagtggctcatacctgtcatcctagcactttggtaggctgaggcaggatgaccacttgagctcaggagttcaagaccagcctgggcaacatagatctcatctgtatttttttaatttttcaaattttaatttaaaaaatacttttgcccaggcgcagtggctcacgtttctaatcccagcactttgggaggccaaagcaggtagatcacctgaggtcaggagtttgagaccagcctggccaacatggtgaaaccttgtctctaccaaaaatacaaaaagtagctgggcatggtgtcacacacatgtaatcccagctaattgggaggctgaggcaggagaattgcttgaactcaggaggcagaggttgctgcgagccgagatggcactccagcctgggtgacagagcaaaactctgtctcaaaaaaaaaaaaaacagtttcaaatatcttagagtcatgcctgtcttgtgtttattacaggcccttttttcaagcagccttctctttctcaaatacaacaatattatagggtatctttctctgaatttcaatctagccttctttactgcccagaacttagcaaaaatcctatggggagaactggcaggtggggaaaaccagctatgcatttgaagcttctccagattctactctgtctagccagctcacatgaccataaaagctggctgctttctcattctctctgagtagtcttgcctctattctggcaagtctaatctcccccaacccatgccgagactcaacaaatgccctcatagaggaaagcagtcatgaatctccactcactttgggagggtcccttctgctctggaatttaattccattagatttccagccttccagtatctctaaaaagaaatatatatgatttttagtttatccatatatattttttctaattgctatagtggacacaatggtctactgctcccctcttacatcctatatcctaaccaccaattctaaatattttaaattcccattacaatgtcttattttattcatgagttattaaaaaaaaaaaaccaaaaaacaaaaaaccttttaaggccgggcacggtggctcacgcctgtaatctcagtactttgggaggccaaggtgggaggatagcttgaggccaggaatttgagaccagcctgagcaacatggcgagaccccatctctactagattaaaaaatacataaaaaataaaatttaaaaaaaaaacaacttaaatttgtacatttgtaatttccaagtatattgttttaaatttgatcattttgttaattttaacttaattatatgttgatttatggcctatatcagggattgactaattacttctgtaaagggccaggcagtcacaattgtaggctctgtgggccatatgatctgtgctgttgtaacaaaaaaggagccatagacaacatgtaaatgaacgggtatggcttggttctaataaaactttatttacaaaaataagtgacaggttggatttgtcctgcaattcagtttgtcaatccctggtctaaattatcttaattatttacaaatttattaagacttgctttataaatatgtttgctttgaaatttgagtgcttttcatgtgcacttaaaatatattctgtattagctgggcacagtggctcatgcctgtaatcccagcactttgggaggccgaggcaggtggatcgcctgaggtcaggagttgagaccagcctggccaacatagtgaaatcctgtctctactaaaaatacaaaaaattagctgggcgtggtgccaggtgcctgcaatcccagctactcaggaggttgaggaaggagaatcgcttgaatccaggaggcagaggttgcagtgagccaagattgtgtcattgcactccagcctgggcagcaagagcaaaactccttttcaaaaaaaaaaaaaaaaaaaaaaaaaaaaatacatatatatatatatatacacatatatatattctatattaaataagtaattctatatatttattagattaaacttgttttgttgttcaaatcttttataactttgttgattttgtttgtttgcttgcttgatctaatggcagagaaaaatacatttaaatttattcttgtaatgtggatttgtcagagtatttctgtaggtctaacaattcttgctttaatatttagaggttaatttattagaatattaacatctggccaggcacagtggttcatgcctgtaatcccagcactttgggaggccgaggcgggtggatcacctgaggttgtgagtttgagaccagcctggttaacgtggtgaaatcctgtctctactaaaaatacaaaaattagccgggtgtggtagtgcactcctgtaatcccagctactcgggaggctgagccatgagaattgctccaacccgggaggcggaggttgcagtgagctgagatcgtgccactgccctccagcctgggtgacatagtaagactctgtcttaaaaaaaaattaatatcttaattttaagatattaattttaaatgattaaaattatttaattattaattaacataataattaaacatcaaatcattcaatcatttaattaataataattataactataactattatctttatatataattacatataataggatattttatatatctatatatatcctacatatatgtaggatggaagcgaaggattgataaatgtatcttctcccaaagaagacaagtatttcagcatgcttttatgtattttagtctctcttacccctatagcccatcatactgaaatggtctagaattttagttatgtgctattattcataaactttcacttatttggcttcctctaagtgttttgacggagagatattatgtggcaagctgagggtttaaatcactgagaatatttttattatgccatcatatttgaatgctaatttcgctggatataaaattctagattcaaagatccctttcttctgttctttaaatctattaccttattcttttcttgcatcattggttgcaagtctaatgccaatctggttcttgtttctttttgagtaatctgttttgtgtctctgaaagcatttaaaattttctttttggctgggtgaagtggctcatgcctataatcctggcactttgggaggctgaggcacgaggattgcttaaggccaggagctcgagaccagcctgggcaaaatgttgaaaccccgcctctattaaaaatacaaaaattagccaggcatggtggtgcccacctgttgtcccagctactcagaggctgaggcaggaggatcacctgagccttgggaggtcgaggctgcagtgagccatgatcatgccactgcactccagcccgggcgacagagtaagaccctgtgtctaaataaataaagaaataaataggattctactttagaaattttatctagcttttttcatttattattatatattacaaaaaggctttcccactctccatcttttgtatttttgtagctccttataagcctaaataaaatactatttaccacacaactgagtgctgataaaagtggtttgttttaggccaggcacagggctcacgcctgtaatcccagcactttgggaggccgacacaggcagatcacctgaggtcaggagttcgagaccagcctggccaacatgacgaaaccctgtctctactaaaaatacaaaacttagctgggcgtggtggcaggcgcctgtaatcccagctactcaggaggctgaggaaggagaattgcttgaacctgggaggcgaaggttgcagtgagccgagattgtgccattgcactccagcttgggcaacaacagcgagactccgtctcaaaaaaaaaaaaggtttgttttatagtgaactgtggagggataagggacaaagctgggcacaaaaatagatctgatggtagggttaggactgagggggcagaggaaatgagactgacatttcctagggaaactgacaggttagccaatgttcctattccaatccatcttcttggaaactgcctgccatttcctctgacatctgaagcacttgctgtaaagcactcactgcttacactatggctgcctggctggctttccttgagaatatgtatatttaatctgtattttgtctatgaagctttttgagggctctgtagttctactccacacattgcccactcacccatcccattttcctccggtagctgctacatggaaagtactatggatcaaattggaaatccatctctcctctcaaaggcagctaaagctatgtggtcaggctctgggccccagattccagtcctgatttctgagtctgctttccaggtcagggaatgcactggggctgacgacaaggctggaacgtcccgggattgaagcttggatccgaactgttggacggcgtctggagttttgcacaaaagagaattgaattgtagatcagctgggaagttactgtggtagtcctggtgccctgcggcctccagcgactggaaccctgtgggagcacatagctggcattttttgctagagattaggaagtcttttgcttcctctgtgaaaaggcttgaattcaatggactgtgtggtaagatgaagttgttttttttttcccttattgataaaaataaaacagagatttggcttgggttattacgcagtggtgggcacatgagcttgctctccagtgtttggcgggaagccagttgaagagcatgtggttacatttttgtccggcatcatcaagagtgtagagaagctgtgattctagcctcagaggagcgagtttttattgtggggtgactcttcaaagaccatctttatgcaagaaatgtcagaggcccatttcatagtaagtttctttggaagttttgttttcgtcgatgctatattatcactcatgggctgatgtcgtctccttatgatggtgtccctaagagccttcacaggcctagggagcactggttggtggtgggaggcccaggctgagaggcaggtctctgtgttgtatttcttcctgggctttagtctgtctctttctaaaatgggctaatcctctctctgccctcttcctcatgtggtgaagggcgttgggacaacatgcaaatatggttcaaaggagaagtgaagctgctcttttgtactctgtcacatttgcttgctctgaattgggtcttttgttagcacattctttgaagtagaacttgtccatggttgactttggtgtcttgatttggagaagaaattgagtagtgcccaactgcaggtagactgagaggctgaactgggtttgcatggggtttgcaggatgtgcagaatggttaaatgaatgtatgaatgaacatatgtagatcgaatgtttgatggggaacctcagaatgacccaagaaacatgtttctccagaaactaagtagatcttgggctgtgaagtatttagtacccataacaagcaatgatagtttaaatatgtagtccaaaaatttcttcctcatcagtcaagtcataaatgcaggacttaaaggaaaccacatgtgagaggtgtctgtgacctaggatattggaggcctgggtcacagttaggaatcaggacctcgcaaaatttacttaacattctccagaatgtggcccaatctacaaagccaccctcatgtcagctgctcagctggagagcacatgtgcttgaagtttctttcaccttcactcttgctttaataaaagcatgtataagtccaggagcttattttatactttggttgatcagcgattgtgtcttcactaagaaccacccatattgtcatccttgggcagacacgaggaaggatgaaaggattgacctgcgagaatctagagaactaaggccaagggaagcaggtcagatggaggtagattgcatctcagatttaactggccaatgatgaaaaaaggttttgttttttttttttagacagagtctcgcactgtcacccaggctggagagatctcggctcactgtaagctccgcctcctgggctcacgccattctcctgcctcagcctcccaagtagctgggactacaggtgcctgctaccatgcccagctaatttttttgttttgtatttttagtagagacagggtttcactgtgttagccaggatggtctcgacctcctgactttgtgatttgcccacctcggcctcccaaagtgctgggattacaggcgtgagccaccacgcccagcccggaaaaggttttttaaagagtgaggtagcacctacctggatcttgtcttgggtgggtgctatggtctgcatgtttatggccccccaaattcataattgaaacctaatctccgatatgataatattagaaggtggggtctttggaggttattaagtcatgagggtggagccctcacgaatgtgattcatccccttataaaggagactctagagagcttgtctgccccttctaccagtgaggacggagtaagaaggctgtctttgagaaatgagccctcaccaggcaggcaccaaatctgctggtgacttaatcttggatttgccagcctccagaactgtgaaacatacatttccatcatttgtaagttacctagccaatggtaatttgttgtagcagcctgaacggaccaagacagtgagggtgggagtggaatatgatgtgctaggttctttccagttttcaaataatatgcttttaccttctggagtttcatcccctgtgccactaatctctgaattgctaaaatctttgcatttttgtctcctactctccactttatcaaacaacctgtcctatgtctctgtatagctgcagactcttatcagacctctcaaaatatcgtttatgacttcctcttccatgtggaggacatgagagagtgagagagaactgggatcttctgtacttttaatgagtgaatccacatgattgtaggcatctaaaatagggctctcaaactttagcaggtcacagaatcaccaggagggcttgttaaaacacagattcatggttccaccccaatgttttccattcagtaggtctgtggaagggcccaagaatgtgcatttctaacaagttcccacctaatgctgttgttactggtgcagggaccacactttgagaaccaccaccctagaggacggggaccaagccagcccactctcagtaaaatcccaaatgcagagggggcagattaataagtaccagggtgtgctgtcctcttcctcctctttctcttcctcatcctcctcctttatcgaggcttacctgatccctgcctcaggggcctccaaagaaaactctgacttagaccaatgtgtcccagattcaatgtcactttctataggaagccgttcatgaaccccaggattagatgttgtggcttcctatactttttcttgatagctatcatgattcacaatttgcaactgtgatttgtgtgatttcttaatctctgtttcctccagagaatgtaagctccatgaagacaggatatacgaatagtaggaaaaaaggaagggtttgggtggggaatggtggtgagtcacccttaggattgtgcacaataaaagagagtgaaacaacagattttgtccccaaagaataaaggaaggggagggaggaggaaggaaaaaggtggcctggaatatccattagaacgttggctgccaagtctagcccagctctctctggtgccaaccagaggtttgcctgctctattttggccacagagtgggcatttcatctctccacgcattttaaaatcctagttgtttctttttttagctctgagctacttacccgctctaagcctcagctacagcacccataaaacaaagaattaaggctccagggctgaagagacctaagtacaacacccagctctgctactgttgcatttccatgagtgcctgaattaactcctgtaagcgtcggcttccctcctgaaaagggtttctactcctaatcttgttgggacacttccaggaatcagggcacatgaagtccttagcacaatccctggctcaatgcacatgagtggccattgtcatcaccatcttcaatatcaccgtcctcctcaccattgtcaccatttctgtccccacacccaaggtttctgaggtctcaatgggataaaataacttcataaccatgaagcactgtctgaatgtcaagggcatccaagtgccccatcccctgcccacaagtcctggagtaacatccaaggatgccttccttccccaggacgctggcgcaggctcaaccccttgcaagcctttggtgactcttgattttacgacaaatacatcttttgtctcttctgttttcaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggtgtctcaagtcatcccaaggcaactagggggttgcctgggctgtgacggcctcacttctgcatgagactctctctctggcttttcgcattaagtagcttcctgtccttctctgtaaaacaaaatgaatgagctgggtgcggtggctcatgcctataatcccagaactttgggaggccgaggtgggtggatcacctgaggtcaggagtttgagaccagcctggccaacatggtgaaaccccttctctactaaaaatacaaaaaaaaaaaaaattagctgggtatggtggcaggcgcctgtaatcccagctacttcggaggctgaggcaggagaatcgcttgaacccaggaggcagtttgtggtgagccaagattgcgccactgcactccagcctgggtgacaagagcgaaactcagtttcaaaaaaaaaaaaaaaaaaaaaatgaatgaaggtataatctggcagggtgcggtggctcacacatgtaatcccagcactttgagaggccaaggcgggaggatcacttgagaccaggagttcgagaccagcctgggcaaaatagagagatcccatctctaccaaaattaaaaaaaaaaaaaattagcctgacgtggtggtgcatgcctgtggtcccagctactctggaggctgaggtggaaggatcacttgggcgcaggaggtcaaggctgtagtgagcccatgatcgcaccactgcactccagcctgggtgactgagtgagaccctgtctcaataataataataataatataaataaaaataaaaataaagagctggctgggcgtggtggttcatgcctgtaatcctagcactttggaaggccaaggtgggcagattacttgaggtcaggagttcgagaccagcctggccaacatggtgaaaccccatctctactaaaaatacaaaaattagccaggcatggtggcaggcaactgtagtcccagctactcaggagactgagggacgagaatcgcttgaacacaggaggcggaggctgcaacaagaggttgcaatgagccaagttcgcaccaccgcactgcattccagcctgggtgacagagtgagactctgtctcaaaaaaaaaaaaaaaaaaagaaaagaaaaaaagaaaaagaaaataaagagctatccaagtctcaggatcttaaaaggtagatcctggggtttaagcccacttattttacagatgaggcccagagagaggcaaacactttcccaaggatacacagtaatttgtaactgggccaaagctcactatagttaagtctttttgtttgaggtgactgagataatgccatctatgattttttcttttaaggcaaatgctgtgctgatattcctcacagtttgagacttgtaaaatgcctctcttccctgagtacccatctgtcctctactaccctcagggtttgggactgatgctctgcagttgagggacagtgtgcaagattggttaagaatggaggagcctgatttcaaatctcagcttggttagcttacagccatatgaccttgggaagctacttgactgctgtgagcctcagtttcctcatgtgtaaaactgggaaaatagaacttatgaggagttcttgtgaactaatgcctgtgaggtattatatttatagcagtgcctcgcagacaggaagtattcaataaatgctaatttattgaatttaatgacctccaagagagttgcttaagggcaaagtggaagtcaattgaatagtgggtacatcctctctgaaagcaaggctaaaactatgtaaaaaaaagcatcactggaaaggaagaaggaatccagctgcttaagccaagtggagtggctcactcgtgtaatcccagcacttcgggaagctgagagaggaggatcactggagcccagcagtttgagaccagcctgggcagcatagtgagatcctatttccctttttctgagacagaatcttgccctgtcgcccaggctggagtgcagtggcacaacctcggcttactgcaacctccgcctccagggttcaagtgattctcctgcctcagcctccagagtagctgggattacaggcactcaccaccacgctcagtaatttttttagtttttcttttttcttttttttaagacggagtctctctttgtcacccaggctggagtgcagtgacatgatcttggctcactgcaagctctgcctcctgggttcacgccattctcctgcctcagcctcctgaatagctgggactacaggtgccagccaccacgcccggctaatttttttgtatttttagtagagacagggtttcaccatgttggccatgatggtctcgaactcctgacctcaggtgttctgcccaccttggcctccccaaatgctgggattacaggcatgtgccaccgcacccagccgtgagatcctattccttaaaaaaacaaacaaacaggccgggcgcggtggctcacgcctgtaatcccaacactttgggaggccgaggtgggtggatcgcaaggtcaggagatcgagaccatcctggctaacatggtctctactgaaaatacaaaaaattagccgggcgaggtggcgggcgcctgtagtcccagctactcaggaggctgaggcaggagaatggcgtgcactcgggaggcggagcttgcagtaagccgagattgcgccactgcactccagcctgggcgacagagagagattccatctcaaaacaacaacaaaaaacaaacaaacaaacaaaaaacagaaaggaatccagctattagcaaaattcaaatgaattgtggatttttctgttattaaaatgtagagatatcaggatccctaaactcaagtaaatgacacaataaacaaagcatcaaatttgaagctgtgttatgatggtgcctgtgccagatttgggggaagggcaatacttggcttacacagatgctctagatcttgaagagggagagaggggcacagttctgcggcgacatgtgcgagtaccagagagagggccagttacttcggggtggagagtatatggagaatggaatgactagctataaaccagcttgcatggtgggctggtggaaacaccagtttctacatgacctctagaccaaacactctctagacaaaaagcaactctgctttgaatgaccttcaaagcgaatgccctgggccagtcccaagggttccttcccctcctcctactccgtctcctgggtaacaacattgtaagactgggaagaaaggaggtgatagcataatcttctctgtcatgttacagacccagggagcttttaagaaataaataccaatgggaaagaggtaacatgcattctctgcaagtactttggtaactcatagcagtgttttaactagactcgggaagttgcctggggatcagaaaggaaggcaaaaatgtgtgtggaatttgtcaaaatttgttaagcccatatagcataataaggagaacatctatctacaaaaacaaagttaaatcataaattatagctgagtacagtggctgacacctgtaatcccagcactttgggaggctgagggaggagaatcgcttgagcccaggggtttaagaccagcctgggcaacatagtgagatcccgtctctacaaaaaattaaaaaattagccagctgtggtagtttgagcctgtagtcccagctgcagaggctgaggtgggaggatcacttgagctctgaaggtggaggctgcagttagtgtgattgcactactgcactccagcccaggtgacagagcaggacgctgtctcaaaaacaagcaaacaaataattgcaaggcatatattttatttttagatcacgctttacttttttttttttttgagatggagtttcgctctcgttgtcctggctggagtgcaatggtgcaatctcggctcactgcaacctccgcctcccaggttcaagggattctcctggctcagcctcccaagtagctgggattacaggcatgtgctaccatgcccggctaattttttgtatttagtagagagggggtttcacctcgttggtcaggctggtctcgaactcctgacctcaggtgatccacccacctcggcctcccaacgtgctgggattacaggcatgggccacctcatgaggcgcctggcctcatgctttgctttgaactaggggaaccatcagtgcctctgtcgaggaagctcatagagaaaccagggacaaatcctagaaggctttacgctttcagccagggctctccatatcattttggttatgcactccatcagtaaaatatttttgtagacacattgtattagtctgttttcgcactgctataaagaaatggccctcaattatgtcataataacatcacacaagtatttcagttgaaaaaaaagaaaagaaagaaaaagaaatgcccgagactgggtaatttaaaaaggaaagaggtttaattgacttacagttcagcatggctagagaggcctcaggaaacttgtaatcatggcgggaaggcaaaggggaagcaaggcaccttcttcatacggctgcaggaaggagaggtgcagggtgaagggggaagagcctcttataaaaccatcagatctcatgagaacccactcactatcacaagaacagcagggggggaaccgcccccatgatccaactccttccacctggtctctcccttgacatgtggggattatggggactatggggattataattcaaaatgagatgtgggttgggacacaaagcctaaccatatcacacattcctcagtacatatattttaattattttgagattatatatctttataagtccacttatgcgaaatggccagaaggcaaattcacagacacagaaagtagattagtggttgccaggggctgggggaaggatcgaatgagaatggctggtaatgggtatgggtttccttatagagtgatgaaaattttctggaattagtgatgatggttgcacaaccttatgaatatacagaaaaccactgaattatacactttaaagggtgagtcttttggtatgtgagttatagctcattttttaaaaaatcacatataaataatgtgtacattataaagaatagccttaaaaagttatagggtgagattttaaaagtcgtaagtagactgaatgcagtggcttacacctgtaatcccagcactttgggaggctgaggcagggtaatcacttgagaccaggggttcaagaccagcttgggcaacatagcaagacactgtgtctacaaaaaaaaaaaaaaaattaaaaattaggctggcatggtggcccatgcctgtggttgcagctactcagcaggctgaggcaggaggattgcttgtgtccaagagttcaagtttgaggctgcagtgtgctacgatggcaccactgcactccaacctggtcaacggactgagactctgacttggccttttggagatgtctttgctaatttccacttctattggatttcctctccaaagcatgactctttctttggacatagtcataagcagagaaggttgtagttggtgacgaggtaccacttccagaccaggctccagggaatttcttctagaatgacaggctgccagaaaccttgactgggtgcagtagctcaggcctgtaacccagcactttaggaggctgaagtgggaggtttgcttgagcccaggagttcgaaaccagcctgagcaacagaagctgcagtgagctatgatggcgccactgcattctagtctgggcaacagagcaatactctgcctcaaacaaacaaaaggagaaactttatgacattttacctgggtttacgaatactctagaaatgtgtctgcactatgtcttggttctcagtattagggtgtttagcttcctaattggtgaggacaaaaatgagaccgacaatcctctgaccctgccttctttgaacttggcctttctctaggcgttcaagacccagctgttgagagtagaaaagcagaagaaaggacccgaggtcagcaagtgccctccccacaatggggcagatctgccagcgagaatcggtaagctctggtgtttctttctttctttctttttttgagacgtttttgttccatcgcccaggctggagtgtagtggcgcgatctcggctcactataacctctgcctcccgggttcaagcgattctcctgcctcagcctcccagtagctgggattacaggcatgggccaccacacctggctaattttgtatttttttgtagagatggggtttctccatgttggtcaggctggtctcaaactcctgacctcaggtgatccgcccacctcggcctcccaaagtgctgggattacaagccgctctggtgtttctttagcttctcagagggctcacatgtaccatagcctgctcaacctgctctccctggcagaggggtgtgttggggtccatcttagaggagggaaaactctgaccaagagcacagcaggaaagcgtcatgaggcaaggcaggagccccctcagacccagcctctaagtcttggtgcagcaggggccacttgtgttctgaccaagggaagcccagaggatcgttctgtatccccctggttaattgctttttagacagttatgctgtgaagtcatcagtgtgtgctggaaataggagtttggctttttcttctctaagagaagccccctctggctgaattttatattgccatgtaaaaatgggcttctgcccattaaaaaaaaaaattttttttttttttttttttttttttttgagatagagtctcattctgttgcccaggctggagtgcaatggcatgatctcggctcactgtaacctctgcctcctgggttaaagtgattcttgtgcctcagcctccctagtagctgaaattacaggcgtgcgccaccatgcctggctaattttgtatttttttgtagagatggggttttgtcatgttgcccaggctggtctcgaaaccctggcttcatatgatccgcccacctcagcctcccgaagtgctgggattataggcgtgagctactgcacccggccaattttttttttttttttttttaaattttaacagagacaaggtcttactatgcttcccaggctggtgttgaactcctggcttcaagtgatcctcccacctcatcctcccaaagtgttgggattacagtgtgagccactgtgcccagcccagaagcccgttcttacatcttaaagagctttgattctccccctggatgttgaaataaaccctggaaaatgtttataggataaattatgttctgagtagcgggctcatttcaaattaatctatgctgtaggtgggtccctctgaagcaaggactacagctgttccaccccgccccccaccaacagaacaatctgggaaattgagacacagtgggcttgatctcaaagacaaacacagtgctcatactaactgagtgccctgagcccagaacactctcagagccccatttaaatcactgcagtggcctggcctgtttgctttatgaagactttcccctggtcagcccttgggtggcaaattaattcctgattagtatctgaaagtggacaatacaagctcaaggagttgcttccacctcgaggcaagaggtgagggtcttgggcacgcctggggtggttatctttccctcagtcctacaagagtagcttacaatgccctcttcagcttctttgagaagggctttgcaaagtccagctcaggtgcatccctcctgcctcccagggtttttcgtttgtttgtttgttgttgttgtttttgaaacagaatttcactcttattgcccaggctggaatgctatggtgcaatcttggctcactacaacctctgcctcccaggttcatgcagttttcctgcctcagcctccccagtagccgggattacaggctcccgccaccacgcctggctaattttttgtatttttagtagagacggggtttcgccaagttggccaggctggtctcgaactcctgacctcaggtgatccacccgcctcagcctctcaaagtgctgtgattacaggcgtgaacctctgtgctcagcccctctcaggcttttgagaggattgaattctgtcctgttcctaatgcccaactggaagctctcagcctcattctcctttgtggaatccaaggctcctgtgtggttgtcagtggggagtggaggccactaaatacagaaaatcaaaattcctcttagccgttgggtctcttaggcctcttccttttctcctccttcaccccgcaaccagagtgagaaaagttttgcctgctctgggaaagaaggagcccttctaaacctggaagcttgtttgggatgtcattgccacctctcatggcccccttcttgtgcccctgcctggctttgccagtcccaggcagaatgccaccaggaatttaaagcaggccaggccagccttggagaggtggcacaaagcagccagtgtcacaggcgccatgtggcagtcagcaggtttggactcctgcacccagagttcagtgtcaatctgacgacaggccctctttggtgcttggaggtccagggagaggagcacaggttctgggatctcagacacagatggaaatccagcagctggacgttgatttggtcccatcaattagcccagagcagttgtagttcttattgcctggagcctctgtcaatccatgatctttattgtagctgctgccatttaccaagcaaatcctctatgcccaccactcccaaaggcccagtgaagaaggtgtcattcccactttacagatggggaaactgaggcttagagaggttaaattcctttgccaagcttgtacagctggtcctggcagatccaggacataaactcaggactctctcactccaggactgtgctctttctacccaccatcaagctcaaggctgaaagtgaggtgtgtgactccaaccctatcttcctaaggatagatatattttgagttgttccaagcttagaaactcatgctcgggatattgaaatttccactgttagtgtaaggaagggccaaaaattgcatggtccatttggtttctttctcataggtttcctgacaattccaagccccagagagtatttttccctgttgccttactattaattctcatgtaggcttggaagtatctgcaagccttcattagagccatttcagcagggagttggctatcatgggggtgtcagtgtaaggcctaggcagttttggctttgggcatgtggaaaacctgcctggattgttctggaagctcagactgtctatgggatgctattttttgcttccgtagttttcctaggaccataattttttttaattttattttttatagatgggatattgccctgtcacccaggttggagtgcagtggcacaatcatggctcactgaagccttgaactcctgagctcaactgatcctcttgcctcagcctcccaagtagctgggactagaggcgtgtgcccccacaaccagccagtttttaatttttttttgtagagacagggtcttgctatgttgcccaggctgttcttaaatccctggcgtcaagtgatcctcctgcctcagcctcctaaagtgctgggattacaggtatgagccactgcacccagcttaggaccttgattatgtgaggtaggacaagaagtgctggaaagatcatccctgccctccaggggagatacacacatggattacccctgattcttacagggactacctgcatgtccatgggctgctatgcaagcttccaggaacttcagtctccttccttatagagtgggattgccccttgtgctctgtcactctgggttccatcccttctcacccactaatagtggggaggaagaagaagagctaatatttatgctgtgctttctgggtctgggcactaagataggaggcactttacaggttgttattacagataaagggctgaggagggcctcagtattcgtattcgtatttttcccccagttttcccccaacctccagtgctgcagagatacctgcaggggtgagtggagattgacaatcagaatcctatgagatctccaagttgagagcagagtcctttgaagtccctaggcgtcaccaatatacttgagtttgggctacatctgttctgacttggggctccccagaaagtttgtctctagcagccctgagattggttgggaccaggacccaccctatcccctgctagtggtaggtggaaaggtggggtgaggctctaatccatctgattcatctcccctttcactggacaagactgatttggcctccactggctccagagcaggcatgctggctacactcccaacactcatttctggaggtgtgacttgagcccattaccaagcatttttattcacccccctgctccctatctggcatcttctgtatgtggggacgtttatcaactctgtgctccttgggtagccttcttctgtgcccagtgacacaggacagctcagttcccagcctcagccagatgccctgggcatgttaggcaggtgggctggtactcacatgtgcctgaggttcccagcctcagttcacctccaataggtctaggtttccttttccatgaagtattccagcaaccagaaagtcaagcatctaaacaggccagcttgcacatgatttttggagatactggaggaggaaggaagatatctccaagatatgtatgcactgtcatttctgcctccaaccttgaaacccttctctgtatcagccagcttttgctatgtgtgtggtgtaataaatcaccttaatacttagtggcttaaaacaataatctcttatttaccggcaatcctgtgagttggtaatttggactgagctcacctggaacggctcttctctgtcccatttactgtcagactggctccctcagaggtctgcaggcagcttgaggtctgtggcttctcttccacatctgaaagttgactggctgtaggcaagggtggtaactgggccatgtgccacacatgttcagcagaataactggggctcattcacatagtggtggttgcaagggttccaagagcagcatgggaagtcaagccccgaagcacaagcatatttctttcttttttttttttttttttttttttgagacagagtctcccactttggctcaggctggagtgcagtggcgtgatctcggctcactgcaagctccgcctcccgggttcacgccattctcctgcctcagcctcccgagtagctgggactacaggcgcccaccaccacgcccggctgattttttgtatttttagtagagacggggtttcaccgtgttagccaggatggtctcgatctcctgaccttgtgatccacccgcctcggcctcccaaagtgctgggattacaggcgtgagccaccgcgcccggccctgcacaagcatatttcaagtgtctgtttgcatggcattgctattgtcctatgagcccaagcaagtcacatggccagttctggagttgctgtgagtggagactatgtaaaagcatgggtatagggaggagaattagtgtggctgttttttgcaaacaatttaccacaccctccctatccattcagctatcatcaggaaaaaattcatatgagcttttctcttgattggcagcagcttccaaaatttgtgaggcaaaggaagttataaaaaagcagaatctgccaggggcagtggctcacatctgtgatcccagcactttgggaagttgaggcaggtggatcacttgagcccaggagtttgagaccagcctggtcaacacagagggactccatctgtacaaaaactaaaaaatgtggccaggcacggtgcctcacacttgtaatcccagcacttgggaagctgaggcaggcagatcactcaagttcaggagttcaagaccagctgggccaacatagagaaatcccatctctactaaaaatacaaaaaaaataattagccgggtgtggtggcggatgcctgtaatcccaactactcagaaggctgaggcaagagaatcgcttgaacctgggaggcagaggttgcagtgagcagagatcatgccactgcactccagcctgggcaacagagcgagactccatctcaataaataaataaataaataagccaggtgtggtgttgcacacctgtagtcccaactacttgggagggtgaggtgggaggattgcttgagcccgggaggtcgaggctgcagtgagccttaatcatgccaccgcactccaagcctgggcaacagagagagagagagagagagagagaaagagagaccctgtctcaaaaaaaaaaaaaaaatagcgaggggagggcagaatgctaactcatctttcgcagaccctgccaagagctggtcactgcttgatggccatgttgcctccttgctcatcagggaagcattgcatcttcagggtgggagacacagcggggcctgcggttcagtagggattagatgcctgtgctcccacagctcctctccaggcctctgccgcagctccggtgctgctgcgcttccattactgaccggcacatctgtctttcttagtggattgtgggctccttgagggccgaaccacggttgtctttcatcttggactctccagcttccaacacagtgcctggtacatttgtaagaacctagtgtttgtgtgaataaattcatgaattgcacatgactgagctctgctgcatttcatccagagaattggtaatcatgatagaatttgcttagacattccaaggttacttgtaattacttttgttttctgagcgtgattgattagttataagcatcaatatgttgtgaatgcaagttgctaaaatgcatttgtaacactttacttgtcctgtctttctctaaggctacagcagctgaaaaaccaaaacttcatctacttgctgaaagtgaggtaagaaagctatttttttttttatttccttctgtaacattttctgtaaaagatagtgcgtggcaatcccctttgggataatgattttcagccagccaagcagctgtgcagtggcttctccagggtgtggagcagtattgacctccaacttgctccctgctggactcagtacacctgaacagggaaggtgctttccaagggtgcctagtaacagaggcccccttcttagccctttcttggaagcagaatgctaattgtcagagccaaacacaaggccttcctgccttggggatgcatggtgtcctgattgtgagagaccctgggaggggaaatggaagggtctctcccctcccgtcttttccattttacagtcaggcatgccagaaacttggcacccatctgctctgcacttcaatatggacaagtttcagatctttcctgtcgacatatcccatttagccccaaatcaaagagtttcctgcgctgtttgtgctgacctaccctcttccctcccattccccaagcacacagcttactatctctttaaagtggcaacagagtggatctgagatgggttgcttcatgcgaaggtggtgaggtgtacactttatgaatcagcttgggagaaaagcacagaaactctcgatttcccctgtgtccggggccattacctagtcccaggtgagggccaaagctgggtgtggattcaacctggagccccagagctctgccctgctcctcattccactgattgcgtagctttattcttgttcttttgaaaataaataagactcggtctccagcctcaaaagacttaatgactgagaagtgaagctcaatattttttcaaaagagaaagttacaacataggtgaaacgtgctttaagagctgggtgagggagtggtcaaccccgtcttgggtccagataacaaaggctggatagaggtgatgagatttgcagagagtcttgaagaagaggaaagcatgtgtcaggcgaggaagggcatttcaagcagagagagcagcatgtgccaaaacagagcctgcaaaaatgggaaaaagctggggagactgaggaggttggatgggactgggattggttgtccagttgagaaactctgacagcatggcctgaaggatcctctaggctgaggagtcctgtgattacattgttttctgtctggcagtagcaaggagcttgagctggaggaagccttgggcatccaggaaaccagagagggggtagggggcataagtgtagtgagacctccaggatgtgtgctgtgcaagatgatctacttcccagtgggaagaaagtacagttgaccctgaagcaatgagggggttatggacactgaccacccccacatcatgcagtagaaaatccatatataactttctactcccccaaaaccaaactgctaaaactactgttgaccaaaagccttactgataacataaagtcaattaacaaatattttgtatgttttatatactatattctgtattcttacaataaagtaagctagagaaaagaaaatgttattaagaaaatcataaggaagagagatagatttactattctttaagtgggagtggatcaccatgaaggtcttcatccttgtagtcttcactttgtgtaggctgaggaggaggtagaggagggcttagtcttgctgtctcaggggtggcagaggcagaagaagatccaggtgtaagcaaactcctgcagtgcaaaccggtgttgttcgagggtcaactgtattacaattccattgtcaccaactttttaaagacaaatcaacgttggtggccttgcaggtacccaggactctcacaatgaggaggggttgatagtggccccctcctttatttcctagaccatctttagcatattctgaagcatcgcagctttagaattgcttggttgaggccggatgtggtggcttattcctgtaatcccagcactttggaaggccggggttggcgtatcacctgaggtcgggtgtttaagaccagcctggccaacacggtaaaaccccatctctactaaaaatacaaaaatttagccagacatggtggtgtgcatctgtaatcccaactacttgggaggctgaggcacgagaatcgcttgaacctgggaggcggaggttgcagtgagctgagatcctgccactgcactccagcttgggccacagagtgaaactctgtctcaaaaaaaaaaaaagaaaaaaaagtgcttggtcgggccaggtgcggtggctcacgcctgtaatcccagcactttgggaggccgaggcagatgtatcacctgaggtcaggagttccagaccagcctggccaacatggtgaaaccccgtctctactaaaaatacaaaaattagccaggcgtggtggcaggcacctgtaatcccagctactcgggaggctgaggcaggagaaatgcttgaacccaggaggcggaggttacagtgagctgagatcatgccattgcactccagcctgggcaagaagagagaaactccatctcaaggaaaaaaagaaaaaaaaagaattgcttggttgaagtagtcttacgtatcatgttatttgggtttaattagactgatcctcacaaaataggcaagtggttttaaaagatttctgcataaaaaatgtgggttgagacaggtgtagtgactcatacctgtaataccagtgctttaaaagaccaaggagaggatcacttgaggccagggtcttgagaacatcctgggcaacatagcaagacctcatctctaaaaaaaattgtaaaaattagctgagcatggtgatgtgtgcctacaatcccagctacttgagaggctgaggcaggagaattgcttgagtccaagagtttgaggctgcagtgagctatgatttgtgcccctgcaccccagcgtgggtgacagtgagaccctgtctcttaaaaggaaaaaaaaaagtagaagcttttgaagctaacacaaatgaacaatgagaaaataagatggctgataattttcctacccctggtacagactattcagctacatcatggggttgaaagaagataaagatcttattagatataatgccaagtcagtcaaaaaattaaaaattagcaggctatttaaattctggctttacatatgatattgttaatgatgaactaatcactatgtgtacagagtgccttgagagaattagctaatgacactactaggccaccaaattttaaaatagttcatctttatctctttatttatttattttttggaaacagagtctcactctgttgcccaggctggagtgcagtggcatgatctcagctcattgcaacctctccctcctgggttcaagtgattcttctgcctcagcctcccaagtacctgggattacaggcgtgcgccaccatgcccgacctatgtttttattttttttaaatgaaagtataatttactaccagtcaaacacacaaattctgtaagcttaataagtgtgttgttgttgaaacagggtctcgctctgtcatgcaggctggagtgcagtggtgcgatcttggctcactgcagcctccaccccgtgggctcaagtgaccctcccacctggtctcccaagtagctgggactacagccatgtaccagcctgcccatttttttgtttgtttgtttgtggtttttgtttgtttgtttgtttgtttgtttgagacggagtctctctctgttgcccaggctggagtgcaatggcgtgatctcggctcctgcaaccttcgcctcctgggttcaagcgattctcctgtctcagcctcccgagtagttgggattacaggcgtgcgccaccaggcccagctaatttttgtatttttagtagagacggggtttcaccatgttggttaagttggtctcgaactcctgacctcgtgattgcccagctcggcctcccaaagtgctgagattacaggcgtgagccaccgcgcccagctttgtttgtgtttttttgagatggagtctcactctgttgcctgggctggagtgcagtggcgcaatctcggctcactgcaacctctggctcctgtgttcaagcaattctcctgcctcagcctcccaagtagctgggattacaggcgcctgccactacacccagtaattttttgtacttttggtagagatgaggttttaccatgttggccaggctggtcttgaactcctgacctcatgattcgcctgccttggcctcccaaagtgctgggattacaggcctcagccaccgtacccggcctatttttaattttttttttcagtagagacagggtcttgccatgttgccccggctggtcttgaactcctgagctcaagcaatccacctgcctcagcctcccaaagtgcttggattacagatgtgagccaccatgcccggctgtttaagaagttttaacacacgtatacacctatgtaaccgttgcccagttcaagatatagaacattttcatcaccccccaaaatcccttcacagtcttttccagtcaatacttcccatttcctgtcctgacagtatcactattctgacttctatcaccagagcttttccattcttgaacctcatataaatataatcatacatatgtactctcttgtgtctggttttaatattttaatgttgctgcatatatcaaaaggttattcctatgtaattttgttttttgcttttttttcatgaggcattttatttgtaaatatgtataacatctctagaaaaagaatcccaggattttccttcctgtgtgttttcgtcttgcttctttatggtccatgatgccagctgagactgtcagtacaatgaaatcaaactggccagatggaagcagattattctgcatttctctagatctttgagttgcacatcaaatctggggctgatcatgccacacttgtttagactgcctgtgaggttcacaacaatttgcctagctctgtgatcatccatgatttcaaattcgccaatataaccatgcttcatcatcacagtgagaaaccagacgatgactttggagcatggcctaagaacctggtgtttgtctctcttttcagcattgttgatgctcttgagagcatcagccaggacattaatgtgcaccactgtggtggcgtggaaagatggcaaaaagagccctgcatgattttgtacgtagaaaatcctggaatacccacaaaaacctattagaactaataaacaatttcagcaaggttataggatacaaggttaatatacataaatcaattgtagccaggcacggtggctcacgcctgtaatcccagcactttgggaggctgaggcaggtggatcacaaggtcaggagttcaagaccagccttggtttcagactggtgaaacccagtctctactaaaaatacaaaaattagccgggtgtagtgttgggtgcctgtaatcccagctactcgggaggctgaggcagataattgcttgaacctgggagatggaggttgcagtgagccgagatcacgccactgcactccagcctgggtgacagagcaagactccatctcaaaaaaaaaaaaaaaaattaaattgtacttcttctataaaattgcaatgaacaatataaaaatgaaattaagaaaacaattcctggctgggtgtggtggtgagtgggtcacctgaggtcagaagtttgcaaccagcctggccaacatggtgaaaccccatctctactaaaaatacaaaaactagccagttgtggtggcacacacctgtaatcccagctactcgggaggctgaggcaggagaattgcttgaacctgggaggtggaggttgcagtgagctgagatcacaccagtgtactctagcctgggtaacagagtgagactctgtctcaaaaaaaaaaaaaaaaaaaaaagaaaagaaaacaattccatgtataatagcatcaaaaagaacaaattacttaggaataaacaagagaagtatagacttttactctgaaaactacaaaggattgttgaaagaaaataaagaagatctaaattaatggaaagacatcccatgttcatggattggaagacactattgttaaggtggtaaactccccaaattaatatatagattcaacccaattcctatgaaaatctcagctggcttctttgcagaaattgacaagctgcttctaaaattcatatgaaaatggaaggggtgccgaatagccaaaacaatcttgaataagaagaaagagaactcacatttcctgatttcaaaattttaaaagcaggctgggtgtggtggctcacacttgtaatcctagaactttgggaggccgaaacaggtggatcacctgaggtcaggagttcgtgaccagccttgccaacatggtgaaaccccatctctactaaaaatacaaaaaattagccaggcgtggaggtaggtgcctgtaatcccagctacttgggaggctgaggcaggagaatcacttgaacctgggaggcagaggttgcggtgagctgagatcacaccattgcactccagcctgggcaacaagagcaaaactccatctcaaaaaaagaaaaaaaaaacttataaagctacagtaatcaagacaatgtgatactaacattaggataattatatagctgcatgaactgaaattgagagttcagaaataaacccttacatttatggtataatgatttttttttttttgagacagagtctcactctgtcgcccaggctggagtgcagtggtgcgatctcagctcactgcaatctccgcctcccgggttcacaccattctcctgcctcagcctcccaggtataataatttttgacaaagatgtgaaaacaattcaatggggaaagaaaagcctttcaacagatggtgctaagactctgtctctacaaaaagtaattttaaaatttcctgagagtggtggggtgcatctgtggtcccagctacttgggaggctgaggtgggaggatcacttgggccctggaaggtcaaggctgcagtgagctgtgattgatccactgcactccagcctgggcaaaactatgggaccctgtctcaaaaaaaaaaaaaaaaaaagtttgtaggtttcatttgtttgctttgtttgtttgttctgagatacatttacaggtagaattcttagggtttggtaacaggttacatgtggagcccatgggagtggaaggagttcaaggatgatggcagattttcagcagaggcgatgaggggctagttctgcctggaacactcttttcctagacactggcatagtgtccctcatcttattctggtttctgctcaaatgccgcatcttcagaggtccttccctgtccatcctgactaaaatgaaatccctaccctttatttgttcaacgtgtgtatcagttagtattagatttggctggcagtaacagaaaactccaaaatagcatttggataaacacattggaattttgtttttctctcaaattttagaaatatagaggtaatgtggtggggggaggggggaggctgatatggggcagcttgatgacaaggatgcaggttctattctattttgttgctttgttttgtatgggcatcattcccagagttatctcttttttttaattagaataacacacatgtattatctacgatttttgtaaccacccagagggttcactttgcccactgcctagacagagctgatttatcaaggtagagaattgcaatagagaaagagtaactcatgcagagctggctgtgtgggagaccagagttttatcattactcaaatcagtttccccaggactatttctctattgcaattaaatccatgcaccatgggtcagcagtgaccggcctgtagagacagtagcggagtcaacccccagtccaagagaagtaggcggccacttggactggcctctggatccgtcaccagagggaggctaccgaaccaggattacccttatggcaggtagtcttaagggcaatcctggacaagctcccaaacttgtaaccgcccaacaggttcaccttgcccactgcctagacagagctgattcatcaacaggggaattgcaataaagaaggagtaattcactcagagtcacctttgcgggagactggggttttactattactcaaatcagtctccttgagcatttggggattggagttttaaggataatttggtgggtaggaagcagccagtgagtcaggagtgctgattggttgggtcagagatgaaatcatagggaattgaaactgtcttgcactgagtcagtttctggctgggggccacaagatcagatgatccagtttatcaatctggggggtgccaactgatccatcaagtgcaaggtctgcaaaatatctcaagcactatcttaggctttacaatagtgatgtaatccccaggatcaatttgggagggtcagaatcttgtagcctccagctgcatgactcctaaaccataatttctaatctttttgctaatttgttagtccttcaaaggcagtctgatctccagacaagaagagggtttgttttggaaaagggctgttatcatcttgttgtatttttatttttattatttatttatttatttatttatttatttatttatttatttatttttgggggacagagtctcgctctatcgcccagaatggagagcagtggcccagtctcggctcactgcaacctctgcctcctggattcaagcgattctcctgcctcagcctcccaagtagctgggattactggcgcccgccaccacacccagctaatttttgtatttttagtagaagcagcgtttcaccatgttggccaagctggtctcgaactcctgacctcaagtgatccgctcgccttggcctcccaaagcgctaggattacaggcgtgagccactgcgctcagcctcatctttgttttaaactataaactaagttcctcccaaagttagttcagcctatgaccgggaatgaacaaggacagcttggaggttaaaagcaagatggagttggataggtcagatctttcactgtctcagtaatattttgccatgggtgtttcatgtttgtgggtcaggagttgggataagctgagctaggtgtcctgccttgggtcatgctttcctgctcatgtggttgtttgcagcgttcggttccttgtagctgtaggattcacatcttgcttcttctgagaggcctggaggctagaagtccaaattcaaggtgttggcaggcttgtgctccctctgaatcttggagaagaagaccctcccttgcctcttccagcttccagtggccccaagcgttccttggcttgtggcagcatcactcccatccctgcctgcatctttgtatggtcatcttctttctgtgtatgtcccttcacatggcgttctccctgtgtgtcccaaggttatctcataatccaagatgattgcaggatctccagccactctgcctgtcctccagtcagcgggaaggaggaatggcaaagaagcaggaaagccacagaatagctgtgtctcttaagggaggctccagaagctactgagacactctcactttcatctctggccagagcttggtcacatgcctgcatccgactataggggaggctggaaatggaatctttattctgggaggcctgagttcacctaaaaattggagcattgattagtttattaggacaaaggggaaatggatattgtgggatacagctgtgtcagctgcgcctgccttttctcctagtgcctggcctaatgtatatttaattagccatttgtttaccatctgtctctcccgatcagaatgtgggctgtgtaaaaccaaagaagaaaactgaggtaccagttaaaaaaaaagaaaaagaagaaggctgggtgtggtagttcacacctgtaatcccaacactttgggaggccaaggcaggcagatcacctgaggtcaggagttcgagaccagcctggaacatggtgaaaccctgtctctattaaaaatacaaaaaattagccaggtgtggtggcatgcactgtaatcccagctactcgggaggctgagggaggagaatcgtttgaacccgggaggcagagtttgcagtgagccgagatgatgccactgcactccagcctgggcgacagagtgagactctgtctcaaaaaaaacaaaaaacaaaacaaaaaaaacaacaaaaaaaaataagaaaaagaaaaaaagaagaagaaaatgactgaggcgagtctcaatcaatttagagttaattttgccaaggatgagaatatgcccagaaaaaagagacataagccacagtaggatctgtgacccacactttttccaaagagggtttgaggacttcaatatttaaagaggaaagggtggggctgggcacggtggctcacgcctgtaatcccagcactttgggaggccaaggcgggcagatcatgaggtcaggagattgagactatcctggctaacagtgaaacaccgtctctactaaaaatacaaaaaaaaaattagccacgcattgtggcgggcacctgtagtcccagctactcaggaggctgaggcaggagaatggtgtgaatccgggaggtggagcttgcagtgagctgagatcgcaccagtgcactgcagcccgggcgacagagtgagactctgtctcaaaaaaataaaaataaaataaaataaaaaataaataaataaaataaaaaataaagaggaaagggtgagcagtgcaggaaagaggaaagggaaaaaagggaagggtagataaaagagacaaggggttgcattcttttgagactttgattagcttagtgttccctgaacccacagttcacatgtgaaatgaggagggtggaggaacagtcagctatgcattcatactcagtgaatgtgcatttttacataagtaaagtaagcatagaataaaggaagcagtcaaatatgcgtttggcgcaggtgaaggaagggataacttctagtccagtccttgtcctgtacctgtgatggtaagctgtcagtgtacattgtttgggtgaaattcaacagaattctgttttagggtaaagggatttcctcatgagcaaattgtgagggaagccccctgggaagatatgtggcctacctttgcagctacctatgtagggacaaaatgggaggtgttttgggtgacacagttcccaagctaaacactttcctttggcatagggagtttgttggatttttgggttgttcaccacatttccagtgactaggaaagtgcagggcagattaggtgtttcacaaatatgtgttgggtgaataaatgacaaggaggggaattgagaagagtaagtttaaggagaagaacatgactgtgttggaagatactgagtttcgggtgcccatgggacatataagacttgattctcataggcagctggaaatataatcacgaacttgggagggagatgtggctgaagcccttgacaagagtgattctttgggaagggcatagcgagacagacctacagaaaacagcgagagaggagacatactcagcccactcagtggaatcaacccaagccagaagtctccacccccaccccccgggggagggcaacttcttccataacccacttatagcccctctggccttgcagatctgcctctctgtttggtttgagaattccccttataaaggaactctgcagggcccagatccacttgccacgctttaggaatctaagccacgactcagtctcctcggtgcaggttcttggaccccttcactggacctgagtgaaataagagaaataaggacaatatagtaaaataaatattgcattttgtcggaatgacaaggtgggctggagacacactgccttggcttggatcccagcttttccattcagttgctgtgtgaccttgagaaagtcacttaatcaccccgtgattcagtttcctcatctataaaatggggatattacgagtatccacctcattgtgttgttttaaggatcaatcagtcaataaataagtaaataatttagaacaatggtgtatagtaagttctacctaagtgctagctattaatataaagccaaatgtatttagcttacaaagcaaccattatttttacttctctgttttaaaatatattttcttttctttttttttgagatggagtctcactctgtcagccaggctggagtgtggtggcacgatctcggctcatggcaacctctgcctccccggttcaagtgattctcctgccccagcctctggagtagcagggactataggtgcacaccacacgcccagctaattttttgtatttttaatagagacggggtttcatcatgattgccaagctggttttgaactcctgacctcaagtgatcgacccacctcagcctcccaaagtgctaggattacaggtgtgagccaccacgccccgcctaaaatatattttcttttaggaaagcggttcccaacctttatggcactaggcactggttttgtggaagacaatttttccacagacccgtgtgtgtgtggggatggtttcggggtgaaactgttccacctcagatcattatgcagcaggacaagctgcagacaaaactcctcagacaccgagttaaagaaggaagcggtttattcagccaggagcatcggcaagactcctgtctcaagagccgagctccccgagtgaacaattcctgtcccttttaagggctcacaactctaagagggtccttgggagagggtcatgattgactgagcaagcagggggtatgtgactgggggctgcaggcactggtaatcagaacaaaacagaacaggacagggatttttacaatgcctttccatacaatgcctggactctatagataacataaacggttaggtcaggggtcgatctgtaactaccaggcttaggtcaggcagggccaggcctggtttcgggtctggttccttgctttcgggtctggttcctgggcgccaggctacctgcctttagttttgcttctctttctttttctgagtataaaacaatatgagagggtctgtctctcttctctcaattaggcactagattctcataaaaagtgcacaatccagatcctttggatgagcagttcacaatagggtttgtactcctacaagaatctaattgcactgctgatctgacaggagacagagctgaggcggtaatgctcgctcacctgctgctcacctcctgctgtgaagctcagtccctaacaggccacagaccagttggggaccctactttaggaaattatgattataggatatgaaaatcatacacctaaaaaagatcctggtctggcatggtggctcatgactgctaattccagcactttggaaggccaagtcaggaggattgcttgagcccaggagttcgagattgcagtgagctatgatcataccactgcactttagcctaggtgacagcaagactttgtctcttttctttctttcttttttttttttttgagacagagtctcgctctgtcccctaggctgaagtgcaatggcatgatctcggctcactgcaagctccgcctgctgggttcacgccattctcctgcctcagcctccccagtagctggaactacaggcacccgccaccacgcccggctaattttttgtatttttagtggagatggggtttcactgtgctagccaggatggtctcgatctcctgaccttgtgatccgcctgcctcggcctcctaaagtgctgggattacaggtgtgagccaccgcgcctggcatgactttgtctcattaaaaaaaaaaaaaaaaaaaaaaaaaaagccgcgaggtggctcatgcctgtaatcccagcgctttgggaggctgaggtgggcggatcatgaggtcaggaaattgagaccatcctggctgacacggtgaaaccccatctctactaaaaatacaaaaaattagctgggcgtggtggtgtgcacctgtagtcccagctcctcgggaggctgaggcaggagaatcacctgaacccgggaggcggaagttgcagtgagttcagattgcaccactcggccaggcgaggtggctcactcctgtaatcctagcactttgggaggccgaggcaggcagatcacctgaggtcaggagtttgagactagcctgaccaacatggtgacaccccatctctactaaaaatacaaaaaaaattagccgggtgttgtggcgcatgcctgtaatcccagctacttgggaggctgaggcaggagaattgcttgaacccgggaggcggaggtcacagtgagccgggatcacgctactgcactccagcctaggcaacaagagcgaaactccatctcataaaaaaaaaaaaaagagattgtaccactgaactccagcctgggtgacggagtgaaactccatctaaaaaaaaaaaaaaaaaaatctggccaggcatggtggctcacacctgtaatcccagtactttgggaggccaaggcaggcagatcacttgaggtcaggagttcgagaccaggctggccaacatggcaaaactccctctctattaaaaacacaaaaattagccgggtgtggtggtggatgcctctaatcccagctgcttgggaggctgaggcatgagaatcgcctgaacccatcaggcagaggttgcagtgagccgagatcgtgccactgaactgcaacctgggtgacagagccagactttgtctcaaaaaaaaaaaaaaaaaaaaaatcctttctaagccatataaaaactcagaatctaatttttgtttatatgtttaacttgctgacccatgtcatcttagagcctaggaaccctgcctaggtgttgacatgaactctgtgtgagcattttccagtatatcttggtgctgttgataaagagtcagtctgtaaaatatttgaagagattattctgagccaaatatgagcagccagtagcccatgacacagccctcaggagatcctgagaacatgtgccccaagcagtcaaactacaagtttattcatttcaggaagacaataaaatatcagtcaatacatgtaagaggtacattggttggctgggcctggtggctcatgcctgtaatctcagcactttgggaggctgtggcaggcggatcacctgaggtcaggagttcgagaccagcctggccaaaatggtgaaaccctgtctctactaaaaatacaaaatttagctgggcatagtggcaggcacctgtaatcccagctactcagggggctgaggcaggagaatcacttgaacctgggaggcggaggttgcagtgagccgagactgcaccactgcacttcagcctgggcaacagagtgagactccgtctcaaaaaaaaaaaaaagtgataaggggttgtggagaccaaggttttatacagatgaagcctccagatagcaggcttcagagaaaagattgtaaatgtttcttattagacttagagagtctgttctattctatcagtctgttgatgttaatgctggtcggatgggactgaattccaaaagggatgaaggtatgatgaagtatgtctgacacccccattccatcatggcctgagctagtttttcaggttaactcttgaatgccctggctgagaggagaggttgaatcagatgatgaggaggatggtgggttagaattttatttgtggtttacaatgctaactcgaaggaaaggattgaggactttttcctggccctgtgaaggtcgttgtgtgtgggtgctgggagaactatcccaggaaactcagggtaactggcaaggtgatttgagattgctctggtccaaaagataacgatttcatttggggaaaccatttcctttggagagctggctgagataaggagctagtctgaagcctgggaaggcctcaacaatctggttaacccttcctcctccaggatacaattctttctttttttttctgagacggagtcttcctctgttgcccaggctggagtgtagtggcacagtcttggctcactgcaacctccacctcctgggttcaagcaattctcctgcctcagcctcccgagtagctgggactataggtgcatgccaccacgtgcagctaatttttgtgtttttagtagagatgggatttcatcatattggccaggctggtctagaactcctgacctcgtgatccgcctgcctcggcctcccaaagtgctgggattataggcgtgagccaccgcgctcggcccaagctacagttctttacgcctatgacttttgtcaggctcagaggcaatttaatgaggatgggatgtctagaaagggacagggtgggactcggatttccttggctcttctgaggaacttttaccttcaaaggggagtagaagccactgcagggtggaaggaaaacttccgcttccccctccgtgaatttgctgaaaagtcaacagacaaaagacgattaagagaaaaggcatacacattttctaatatgcctagaagaaaacacagtgattaccctaacccttcaatggagtacagaagcttatatagccttttatttctgagacagaggctcactctgtcgcccaggctggagggcagtggcatgagcttggctcactgaaatctctgcctcccaggttcaagtgattctcctgtctaagcctcctgagtagctgggattacaggcttgcaccaccacgcccagctaatgttcgtggttttaggagagagatggagtttcaccatgttggccagcctggtctggaactcctgacctcaagtgatccacccgcctcggcctcccaaagtgctgggattacaggcgtgagccaccgtgcctggccatatagcccttttttttttttctgaagctggtaaggagatggggaatatgctaattctgtaattctgcatgatttctcaggagaaagaagggatcagagaattgagattaacttgtaaatggctctctttggaaactgaataagcccgagagacagacaggcattttatccctctaggggtggtgacattcttcagtcttcttttctgcaatagagaatcagataacgggaaggggaagggaaaaaattgttcccccaggggcatccttctggtcttttggtctttcccctttggaggtggggcagtctcttccagtgtctgttgatctttaagggcctttcattcaaaatactctttacacaagggagccgtattttggggtgaattatgttggtttccttcacctccttgggaggtgggaaatgtgtcctgaaaggtcagggcctctctgagtggagatgaacaggtcagggttgagtaaggaggaggctggcaggggcctttatgatacctgagaggactggggcttggatggagcaagagaggcactgatggagtaagattcaggtacaagacttaagtcttgcatcctaggcacggctcttgcctcatcctcatcccagccctaataatgggaggctttttgccggtaaattcccattattaggagctgaaaatgtcaatgccttacaggcgccagtcagcagtgtcaagcagtgggctgggtggggcctgggctggctggagctcccctaccctgtctaaagggggcggtggctgctcagctccagcatatgcggggaaggcgctggctaagataaggagctagtgccatgatgaccacgttgccacaggatcaagtgggtcctgtgtggtgtcacctttaggtgcctgaaatctagattttattttatttattttattactatacatattttttgagacggaatttcgcttttgtggcccagactggagggcaatggcgcaatctcggctcaccacaacctctgcctcccgggttcaagcgattctcctgcctcagcctcccaagtagctgggattacaggcgtacaccaccatgctgagtagctgggattacaggcatgtgccaccatgcctggctaattttgtatttttagtagagatggggtttctccatgttggtcagtctggtctcgaactcccgaccagatgatccgtctgcctcagcctcccaaagtgctgggattacaggcgtgaggcaccggcctgaaatctagattttaaagtgaaatttcttaatttttttttaagggcaggcacaaatttataaaacatcaggtgggccaaataaaatgttacaggccacagttttagcttggtggttgctgatttactgaccctgttataatattggaggtcaggactttgggcaaatgaaagagaaaaggaggcagactgagaatgtgattttacaactccagcctctccaggggctgggtggccagtgtctcctcagcagccttctcccgcaggaagcagaactgtctgcaacgctgatggagtcacagtaaccttcaccccactgagctcaggatctgcagagccactaagaccctggagcaactgccttcagcatccaacagaagctgctaaaaggattatgggtcaattcattttagacatttcttccagatgttcccatggaaagctagggtctaaatcagtggtcctcattcctggcagcacctgagtttcacctggggaactgttagaaagtgaaacttggacggcattcacattagtccagtctctgggtggggcttggacatcagcatttgtagaagctccctaggtggctttggtgcagccaggttggaaaccactgatccaactaatagaaatgctaggttgggatctcttccgaggcatctctttaggacaggctgtgcatgacagtcccatagtgtcagggttctaagatgctccaatggtttaggcactggtcttaattttcgttttttcgctctctttgagaccttaacaaactctatagggctgggcacaatggctcacgtctataatcccagcatttttttctttttttctttttcttctttccttttcttttctcttctcttctctcttttcttttctttctttttttctgagactgtctcactctgtcgcccaggctggagtgcagtggcacaatcttggctcaccacaacctccacctcccaggttcaagcgattctcttgcctaagcctcccaagtagctgggactacaggctcttgccactatgcccagctaatttttgtatttttagtagagacagggtttcactatgttggccaggctggtctcgaactcctgaccacgtgatcctcccacctcagcctcccaaagtgctgggattacaggcgtgagccactgcgcctggccaattccagcagttttagaggtcaaggcaagaggatcccttgagtccaggagttcgagaccagcctgggcaacatggcaagacctcatttcaatttaagaaaaaaaccaaaacacccaagctctataaccttcacatcctcattgactgattaagtgcagataatgatatttgcccttctaacctcaccaggctgttatcaggagaaatgaagcaataaatgagaaattgctctgcaaactgtcaacgttatgtaaacattgctattcagagtgtgctcccaggtgcgggaggtacagctgttatctgttggagatcactcctgaagtaacattcctagtgccatgggtcagatgggaattggtacagacattccaacttagaaggcagcctttattgtcttataagcaggtgcgtttcctggggtggcagcctggcactggtcactccaaccccaacttgtgtaggaggtaccacagtaaatgagtagagagagttcaggggacttgaagggaagtggagggccatctggagagggagggaactaaggactccctgtgggttggggtcttcctgaggatccagggagtaactgtcaaggagccttagcagggatctaagagctatgcaagagcaaaaagaggcaaattattaaggaaattagtgaagtcagcactggaacaacagagaggggacacagcagtgcagcatgggccctggcctcaggaagctgtctgattggggcagataggaccagccccctagaagacagtcacccatatcagttaggcagtcatgactcagtgttacttatctgaggcccaggttgcatgaggggttgggggtgggatggacagagcactggctgggcatcaggactaggctggagtcctggctcaaaactctaccacaacctgacactgggcaagatggcccacctgtggcatcccaggttcctgccctgtaaagaggagtctgggtgtatatccagatggactgtgagcacagcctgagtttgccctgtcgaggtgctgaggcctgggagattggggtgagtagctgtggtccagggaaggttggcaagctgggccttagatgagaggggatgcttggtcaggcagaggtgagtggagaaggcagggcaaggaagggaatatgagcggcgaacaaatggagtggacatggtgggggcagaggatggtgggaagtggccttgttgcggccagagtggaggaagagataagtgggaaagagtggagtcgattacagaaggcctcggaaaccaggcagagatgtttaaattggctctctcaggaaggagagggccatgaagggatttagggaagggtcatgacatgattatgctgcattttagcaggattaatgtgacctggtgctcagaatgacttggatggcatgaggccaggagccgaggaggacagttagaagactcttgtaatatttctggcacagggagatggactgggagttgggaggtggcaataggtcaggcctagagacatttctcaggaaatattgacaggccttggggcctggttgcattcatggagtggggaggaatgagtcaccttgagaagcagtttccctctcaaaggccagggaagacaaagcagaggcagctttcctgcctgcaaacaggacatttcagggtaacctggctcttccaagcgtcagcttctccctggctccagctcagataggagttgtaacaacgggttgggcatgggtgatggcaccggctggtggctgggttaagggccatgtttttgattatgcattaggcttattcagcctgccaagtgccaggccctgcgcttgtgtaggagacagagcaattagcaaaacatagtcctccatcctcaaggagtttccagccctgtgagcttggcagatctgcagaactcaaatgaaatggcagttgagaacaaccatcttgttctcattcactccattttgcttaacggccatgtaggtagttccaaatgtttgatgtgtaccagaaaatctctctcttcctggtttataattatgatccagggcaaatccaggttttgttgggcttgaaaattaaataaattggcactctctatggaaaataattcaaatataaatatacaaatatcacactgctaggccctcccagggcctagaagggtaggaatgaaagtgagagtccctgaagctttaaccgcattaacttttcagtcagttctatgatacctgccattccttaagtgtgtattatgtgcacgtattttgcgtacagtattacacaacaatcaaggggaggtgaggtgggcattagtgtcttcatcttatggatgaagacacagtctcagaggtgattcaagatgcccctctgcataggccctaaggcagggggtggggactgtgacctggacaggaagctggggcctcaggactgcatctaagctcctccttttctgtgggtgatggtggctgtcaggcccctgaacctacgtcatccctccctctgatttgactgtacctttgctaggcctggtcaagggctagggactcctaaagtcaagagctagggtagaggttgggggttggatctcagggcaccatatggtgcagacttggttgcaggaaagtgacctatttaggcagaggggctctatacaactgggaccacagcaaaccctagaggtgagcacctgcttcaaagactcacagatccaagctgtgatcctagatctacaacttcctggctgtataaagtccagcaagactgaggcctcactgagcttcaatttccttacctgtctaaccagaatagcaacaacttgtttgtatatttgagctcattacatgtcattttgtaaggcactaaagctcctggaggcttccggaacacagaaataattaatctaagaatcctaaagtggctgtcctggtagcacctctagggagtcctcccatcctacgtaacttcctctgggaaagtagaaaacacggcacctgggaaggggcgctgaaccgtgccccaagtcccagtgggcctggatgcccaagagcaagaggaggcccagaggatggggacaggccacgacctgtggcccaagtcccgcccagagggagtgcgccctgagggagagccaccggagctggtgactcgggggcgggtgctctggggtgtcgctttgggttcagcaatacaaatctgccagctggagattaggcggggcacgccggggagaggtgatgcactgccgctgaagacccaggtaggccggtgcgttcggcctgggtgaggaaggcgcgggacccgggtgcgaggactgcgtagcgtccccggctcccgcttccgcccgctttccacgcccacttctgcaagtcccctccggcacctcggcgtccaccggactcctaggggcgagccctcatttccgaggaatgggaccgccttcgtgcccccggggctgccagtccctagactagccctaggggcttctcgtcccggcggagccgggcggtgcctcctgcctgcgcctcgcacctccccgcctggcacggcccacccgggcacggcgccgccacgcgtgaaggcccgcatcggctccctacgtgggggacgtgcaggatgatgcggggtcgggggggatttcgctgcgtcgcccgccccctttccggcgcaggagggagcggccgccgcgtccccgctccccggccgggacgccaccgccgggcgttgcagaggcgcgccgcaaccaatgggcgtggaggaggtgggtcggctggcggctgtcaccctccaggggacgggagcgcggagaccgggagcgcgcgagctgtcgccgcgccccgggccgagggggaggagccgggggaggaggaggaggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaaggtgagcccccgcccgcgccgccgctggtcctggccgcagccttgcgttccggcatccgctcgccgcctccgctgcctccatcctccggcgcccggccttctccgggccagcatcgagttggactgcagggcgcaaggaaagccttcgccttcgattctaccggcattgtcagtgtctctgtgtgtgtgcgtttttgggaggggggcaatcgggcggaagacccccgagaccgggctgcctgctgcagtgtccttgaaacgggccctggatgtcagataggcccccgggctgtgcggggaggtggccggtgggcccttccgcagggcctgttcgggagggtccgagcgccgtgggaggaggtgtgatcatggagatgctggggaggtgatcgagcagcaggcgggggtgctggctggaggccaggcctcccatatttggggttcctggcggagggtgtcgggtgccccggagaagctgtcgccgggctctcccagttgtttgagctgctcgttaatctgaggacgaggtgacccgcccggcttcccggaacggggaggggcggcgaggccaccggaaactttgctcataggcctcgtgtctggagcggcacgtctgaatggaattttttattcctcttaagctgtaatttctagccagcacaggagctcaaataagcgactggtcatttgagttgggtggacgcctgtggcatgcttgttctagcacttggacgcatgcatcctcctgtcctgaggtgttgttgcctttgacatcttagtgtaaaatactgtccgctggcaggtcttaaaggtgtatttgtctcttctgccagctgtgctaccatattttaaagaaacagcctaagctgtagggaaagacgcccgttttatcagtgccaggtctggtacaggctccaggcccacccaccctgaacgtggtgacgttattgctggggttagctgggatggactggcaaagtcatcttgactttggcgttcagacaggtggagttctacaggtgaaaggcaggagtgacaggccttgattttctgcccggcaagccatagggtgttccatcctcttcctgtgcatctaagatgactccctcatctggcaccataggaaacaggcctactgagggcagcgaccttatcaaggtcacccagtgagttagaggcagagccagtcagggggatccaggtctcccagtgcctccacccaggaacttcaccagggtcctcctggaggtcagcttccaggagggagtgggtactgagagacaaagccgctggggaccctgccgtgatcttggatcccatggtgggtggggaccgggagtgaggtaggtaggagataggcttgggaatgccatctgccattgctctttatggctttaagcactctggggttgtcaaaccgtggcactcgaaacacttgctcctatggagcaccctggagcttccctctggccactgacctgggagctgtgcgtgcgggtgtgtgcatttcatgagttttctctagtggtgttgtgcatcactgatgttcttcccattggaccagggagacagttctcccggcatggcaagaagtgcccagaacaggcctcctgaagccaagagttcactgtcctcctgcacgtggtgtcctttatagctcaagacagtgggctgctgggctggggggtgcctgggtgaccttgtaaacctccagtgtccacacccaccaccacccacaacagactgctggctgttggctgccggtggcctccagcagctgagctgggctgaggtttggactccattcagtgggacatgttttctcagacatacagtgtctagggtgggcccagagctctccactcctgtgggtggctcaattcacatctatggatgcacagtctatctcctaggcccccgtaggtacctgagtgtgtgattcagttgacccttccatccctcctcactccgagtttgggattctgatgttcttcccttctcttccccgagaaccttgctggaggaaggtcttaaggccaaggtttccaccagatattatttgtcaaggagattcttaaaaacaagatgtttgcttgcatttcaccacggacttcctatgctgctttctataggggagtacgtggattcctgccagggggtccactcattttgcatagtggactgtgtggcacagccatctgtgggtgtggtcctggctatgattgcgccaccgcactccagcctgggccttctaaggacagtgacatagtgggtacttgctccagtgacctactcagttttgcccaagtgtgcagatgctggggaccacatctgctcttctggggcccaggatttcttagagaccagctctttccacgtaccactcaccataggaaaggctaggtgaaggtgcgggaccccctgttcttcctgtggggctggactctgcctgcctcccagcagggacctgctgaggatggttcccccccagcgtgggcagccatgatgattcagccctccagctgtaggcagcctccggggctctggagacagacctggcatccctcagtaactctcatctatcttcttgccctcagagccagaggtaggagaagggaagctggggaccatgccggggaagtttttgggattgcttagaatccaaacgtgatcatgaaaatggtgtcatttctttcttcattgcctatgaggcacatcaataattcaactccataaaaatatatcctgggttgaaacagttcaggtgtctgacttcccagcttggaaccccattatccagacggcatctgcataaattggttaatgggtgctgttgaagagggtgtactggcattaggctgagctaagcacaaaacacatatattcctttcactcttctagtgcctgtaggaggaaagggaggcatatgtgtgcttgtgaaggattccattcatcagaatcccagacatctgccagttctgcagctagaggctgggttctttgacctctaagtaactttaaacacgcatctcatctcgccagcttcttccactcggtttagccattaggagcttggagcagggtgaaggattgcatagtgctctgtttgtttagaaagggaagatgggtccaggaaggtcagaacttggcttctaaagaaagattagacttcctttcctccaggcttgtcagaatggtgagcaaatgccagtggattttctctgggcgagatccccataacgctaagtgatttccactagtaggtgatcatgaaaagggtgtcatttctttcctcattgccttgaggcacatcaataattcaactccataaaaatatatcctgggttgaaacagttcaggtgtctgacttcccagtttggaaccccattatccagacggcatctgcataaattggttaatgggtgctgttgaagagagtgtgatttgtccaatggccgaactcaggagtccttgagtacttgacccaggaagacaggggagagtaggcttagcaattaaagggttgcccaaggtacattccttagagcctatgtgttccagctgcaaaagcaagcattaaaaataaataaataaataaaaggccgatgtagtggctcacacctgtaatctcagcactttgggaggctgaggcgggtggatcacctgaggtcgggagttcgagaccagcctgaccaacatggagaaaccccgtctctactaaaaatacaaaattagctgggtgtggtggcgcatgcctgtaatcccagctacttgggaggctgaggccggagaatcacttgaacctggaaggcagaggttgcggtgagccgagatcacgccattgcactccagcctaggcaacgagagcgaaactccgtctcaaaaaaaaaaaaaaatgcccattcattattgctcaggggtgagagaggtgatagttagaaaattgtgaaaaatctggctgggcacagtggctcatgcctgtaatcccagcactttgggaggctgaggcaggtgaatcacgaagtcaggagttcaagaccagcctgaccaatatggtgaaatcccgtctctactaaaaatacaaaaattagctggacgtggtagcatgcacctgaagtcccagctactcgggaggctgaggcaggagaattgcttgaaccggggaggcggaggttgcatgagccaggatcatgccactgcactccagcctgggcaacagagcgaaactctgtctcaaaaaaaaaaaaaagaaaattatgaaaaatctgtgggttcttgcagtggcaaagaaaaaaaagaaaaaattatgaaaagtcagcctgggcaacaaaattaaacctcatcttaaaaaaaaattttttttagcctgctttggtggcatgcacacacctgtagtcacagctactcaggaggctcattgagcccaaaagattgatcccaaaacagtgagctgtgatgctatgattgtgttaccgtactccaggctggatgatagagcgagactctgtctcaaaaaaaaaaaaaaaaaaagaagaaagaaaattatgagaagtgtctcataacctctcaattctgatgttgtacaaatattcagtgagagcttcttggtgaatcttgactttataatccctgcctttcctaccttagatactcctagggtttctcccaagagaagccccatcactttatctggttggatagtttgggaatgtcatgaaggaataaactggcaggcagggtgtctgtgaggtgctttcacatctggccaagctgtgccatgctcccacgctcctactgttctccggagaagacataggcagctttccccttacaagactgatttggcatgactgggactgtctgtgtgtgtctgcagtcagggattcctggcagacagatttagccactggaatcacctctgagcatgcctgagaaggtccagggaagacatggataaagacagggagctgtatacctctgcatccaggaatcagttgtggtcagactgctggcacctgcttatggatttgtttttatttttttatagagacagggtctcaccatattgcccaggctggtcttgaactcctgggctcaggcagtcctcccgccttggcctccctaagtatgcttattgatttgaaaaccctgaagatcaaatctgatcacaggagctcaatcatttctttaaaaaatgtttgatttttttattatgtgcagaggactgtgctaggctggggtgacaactataaacaaggcagaaacggtcccagttctcatggagcataaaatatttgctggccgggcgtggtggctcatgcctataatcccagcactttgggaggccaaggcaggctgatcatttgaggtcaggaggtcgagaccagcctgaccaacatggtgaaaccccgtctctactaaaaatacaaaaaaggtgccagatgtggtggctcatgcctgtagtcccagcttctcgggaggctgaggcagaagaatcacttgaacctgggaggcggaggttgcagtgagctgacactccagtctgggtgacagaacgagactccatctaaacaaaaataataattaaaaaaaaatgaagtatttgctgtgttatatgtgcaaagcatatgggctatgagggcccacagcatggtgtggtcataccttgggtgggaaatccctaggctaggaactgcttacagctaggctgcagatgttagctccttaagtgcttcaggaagctgctcccatccccagttctggggatgtgttagtctgtttggagtagcaggacaggtgcccactgccttctggcctaataaaccttaacaacgggatcttttgcaaccacttaatatacactgggttgtgttcattgtatttgatcttaaagaaaaataggtaaaaattttacagtttgattggtcttgatttctggaaataacattgacttctggtaaacagtacacatcagggatattatacttagaaactttgtaaggtggagtcaaaattaattgtcacaaaaatgtgtattttttttttttttttttttttttgagatggagtcttcgctctgttgcccaggctggagtgcagtggcacgatctcagctcactgcaagctccgcctcctgggttctcgccattctcctgcctcagcctcctgagtagctgggactacaggcgcctgccaccactcccgtctaattttttgtatttttaggagagacggggtttcactgtattagccaggatggtctcgatctcctgatcttgtgatccgcctgcctcgacctcccaaagtgctgggattacaggtgtgagccaccacacccggccatgtattttcttattctttttttttgagatggagttctgctctgttgcccaggctggaatgcagtgatgtgatctcggctcattgcaacctctgtctcctgggttcaagcgattctcctgcctcagcctcctgagtagctgggattacaggcaccagccaatgctcctggcctgcatttttttttttttttttgagatggggtctcactctgtatcctgggttggagtgcagtggtgtgatctcagctcactgaaacctccatctcgcgggttcaagtgatacttctgcctcagtgcccccccctgccccccagtagctgggattacagtcgcctgccaccatgcccggctaatttttgtattttaaatagagactgggtttcaccatgttggccaggctggtttcaaactcctgaccgcaagtgatctgcccgccttggcctcccgaaatgctgggattacgggtgccagctactgcctctggactgcattttttttttttgagacagagtcttactctgtcgcctgggttgtagtacagtagcacgatctcacctccctgcaacctctgcctgccaggttcaagcgattcttctgcctcagcctccctagtagctgggattacaggtgcctgccactacacccagctaattttttgtattttttgtagagacggggtttcaccgtgttggccaggctggtcttgaattcctgacctcgtgattcacccgcctcggcctcccaaagtgttgggattacagacgtgagccaccgcgcctggccgctttttttttttttaatggctttttgtctctgggcatcctggaacacttcgtgagtgtcatgtcgggtatgaattatatatatatgtaattgagattacactataaatgtttctgcacacaactatactaacatatgtgtaggtgtgtgtatgctttcatatgctctttcaaaagcctcagcgaggttgtcagtacaggaagtattattcccgggcttcccagcacggctccctccccagggcatcctgctgcctgccttgtgtgttgcagacagaaggcaagcaatttattccccatttagaaacagagactgaaggcccatccagaggagataaaacatttttctaaggtcgaaagaaaatcaggaataggattcagagggctcttcttgcttcctctgtttccttcttttaggagaaaaacctgtccttgttgattttaatgttttaccttggaacctgtattttaatactgtcccctcacaaatcaatacatttgagttaattttttattatgaaatatttgaggcacataaaagaagattgaggttcacataaacacctctgagtctgctactcagcttgagaagttatagacacaattacaattacattacagacacagttgaagccctttctatgccatctctgagatagtttgctgcttctcccttcggaggtgacctctgtcctgaatttggtgtttatcttttcatgcatgtttttacgcttttattacatatgcatatgtctataaacagtatatggtattgctttatagatatatggttttgatcttttgtaaatggtgctatactgactatgtgtttaagcaatatatggtattgctttgtgtggttttaaacttttttttttttttttttttttgagatggaatctcattttgttgcccaggctggagtgcagtggcacggtctcagctcacagcaacctctgcctcctgggttcaagcaatcctcctgcctcagcctcctgagtagctgagatcatacctggctaatttttttgtatttttagtagagacggggtttcaccatgttggtcaggctggtctcaaaatcctgacctcaagtgatccacctgcctaggcctctttccaaagttctgggattataggcctgagcccccacactcagccagttttaaactcttataaatggtgctatactgtatgtatccttccgccatttactttcttttagctcaacattgtatttttgagattttaaaaatgttgatctacgtaactgtttcattaaactgctctggtttcttacagagtataaaagctccctagttaattcatctattctgcttttgataggcatttgtgtttctaatgtttcaagtgacaaacaatgccttggtgaactttctctagaacaactcattcagcgcatgcacaagtttctctaggctctaagctgtgtacctagggctgagatcaccaggcggagagatgtgtgcgttttcccatatacgagattctgccaagttgccatccgtggtcatgccagttcacactcccatcggaagtatgtgcaggttgcctttgttccacaccaacccttgttatggtcaaacctttgcaaatttgtaatagatgagttttagtctgtttccttcctcagttgtttccattcacatcacagtattcgagctgtgtttaaaattagcccatttcctgagttaccttatcagagtccttgcttcagagtcccacggactgaagttgacagctccatggactgctgctgctgagatatctgcactggggagggatagttgatgcagggaaaggcttaggatggctctccatggcccctggtgctgtgggctgactccgttaagcttttctgggagttgaaacacacatttgtgagctttcacttgcacacactttctctcttcccgggtggatccgacccgggtagggcaggcttatctgttgcgtaaatgtgcccagctctgctcagagaaaactcaagccagcagcctctcagaccgtcttccgtaaaaggagagggtggctgtacccacgtggcagggaaaactgaaccgtgaagtcggcggctcagccctttgcacacagaagctgagctgtccctgtgcgaggcagaaaatgtcggctcatgttcatcttgagtctatgcctgattacaggctccagactcggagacctcgagggtgccttacagggaagggggcattcagtgcctactaggcgcccggcttttctttttcttagcaggggtcttatttaatcatttctagtactcatatgaaccaaagccaacattcattgttgtattcattgccatgtactgtgctaaaggcatcgtgagcctttgcttagttcatccccacaacgcccttgtgaggtgggtgtgatttcagacggtgaggcccagatagtgaacgatagagccagcattcagcctcatcaaggctgatggcagagctcctgcttttattattttctcaattgagttataattcacctaccatgaaacgcatcattgtacagtgtacaattcagtggtttctaatagatttacaaggttgtccgagcaccatcaccatctaattccagaatattttcatcaccctccgaaaaaaactacccgttagcagtcacttcccatttcttcctccacctagcttctggcaaccactatctacctttttttttctttttttttaaatggatttgcctcttatggacatttcatataaatggaataatataaaatgaggctttttgtgtctagcctcttttatttagcataatgtcttcaaggttcatccatgtagtagcatgtgttagcacttcattcctttttattgctgaatgctattccattgtatttatctactacattttgtttttccatttgtcagttgatgggcatttggactgcttccactcttttcggctgttatgaataatgctgctctgaacatttgtgtgtgaatttttttttgtatagacatgctttctttctttcttcttcttttttttttttcagatggagtcttgctctgtcaccaggctggagtgcagtggtgcaatcttggctcagtgcaacctctgcctcccgggttcaagtgattctcctgcctcagcctcccaagtagctgggactataggcgcatgccaccatgcccagctaatttttgtattttcagtagagacggagtttcaccatgttggccaggatgttcttgatttcttgaccttgtgatccacccaccttagcctcccaaagtgctgggattacaggcgtgagccaccgcgcccggccagacatgctttcatgtctgttgggtgtatatgtaggaatggaatttcttggaaaacccctgcttttaatcgatttaaggaggaaggcatcaactccattcagaaatgagcaaacgaaggccccccaggtggtgaattgactttctgatgaccacacaactcatgaatgacagggataggaacactactgctggtcccctgattcagaaatccatgttctttccaccattacacccaactctcattgtgcagtttagggaaacagatgcaaggagggaaagactggggtgggagaggggtggaattggcttgggatcctccaggttccctgccccccatctcctgcccctccccagcaccagcatggtgtctcctgcctgtgcctgctgcctcacccccagccccatttgcttagtgttgatgagccccttccacttgggaaggaaatggatccgataaggtcattaacagtgaaatgttaggaatttgccctgtttttcaaatctcccttttcatttgtctccctctcccattcttgtctgcatttaaaagaggaccccccaggagggcaatgcttaacctgcatgaaaaccccctcaatgctccttgcgatgcccactcctggcctctgcctgggggtactgtaagcagctgtcgattccatcaattgattgacacatggggcttgtcttcagccatgttattcacccagacctcatgtccctgatgtctcctggtgccttctaggaccctgtctgggtgggtgtggtgagtgaagtaggagacccaggctactgctgtgataaagacaccacctcacctttacaaagttctgtttcatttataaaatacttgatttaatcagatgcttactttagttggatctttccatcaagcttggatgtaggaatttcttcctgcatcttacatatggggcaggtgagtcccaggaagtggaattcatgtgatctcggtggccagaaagcagaagagctaggatgggtacacagacctccctaacgccagtgggcaattcttgcagtacctgcagaaccagaacggtggtccagggctccagactccaaagccattgatggggttcaggacatactatccccaaatagtaatatggcatttgagaaaacagcagaagcaggaaggtctctcacctttcccctcccttcttccctgatgcagactctcattcaagaaggtgtctaccttatacccagaagaaagggacatccttatctctggagatacagggacacagagaagaacaaacagggcctgccaagttctcttcagtttatcactattagatcatatcccctttctccagtcacacttcttcacgatcatccacttcttcatcaaacctgacatagggaaatatgcagacttacctgtttcttttctttttttctttttttttttttgagacagttctcgctgtgtcgcccaggctggagtgcagtggtgcagtctcggctcactgcagcctccaccttcctggttcaagcaattctcccacctcggtctcctgagtagctgggattacaggcatgcgccaccatacctggctaatttttgtatttttggtagagatggggtttcaccatgttgactagactggtctcgaactcctggcctcaagtgatctgcccgcctcggcctcccaaagtgctgggatcacaggcatgagccgccacgccgggccagagttacctgtttctttggaccttcatttccttatgaaggcttctgcgtcacctaaaaacttagattaatttgtatacattgttcttgttactctgtcttttgttataggggcctcagccataaacctaagatgggaaggaaggatatttcttttcagctactgcgtgttctacatttcagcggccttcttcatagaaactgtcacccaaggctctgataatggagatatgtcagaaatgctggggctgtgtgtccagaatagtaggcgccagccataggtggctgttgagctcttaaaatgtagcaagtctgatttgagatgtgctgtggcatataaactccacacaggttttcaaaaatttcatgtgacacaaagaatatgaaatagcccgttaatagttttctaatattggctgggcatggtggctcacacctgtaatcctggcactttagaaggctgaggccagaggatcacttgagcccaggagcttgagatcagccagggcaatatagcgagacctcatctctgcaaataattaaaaacgtcagctgggcatggtggcacacatctatggtcccagccacttgggagtctgaggtgagaggattgcttgagcccaggaggtcaaggctgcagtgagccatgattggagtgcactgcactccagcctaggtgatggagccaagaccttgtctcaaaaaaaaaaaaattttttttctgatattgattagacatagaaacaacattttggatatactgggttaaataaaatacattatttcatttgggagtctgaggcagaaggattgctttgattgtttgaggctgcaatgagccttgattgcaccactgcactccattctgggtgacagagtgagattatctaaaaaacaaaattaatttcatctgttctttttaaatgtggctagtaggaaacttaaaattgcatatgtggctcatattatcttcctgttggacagtgctctgctagatggtaaattccatggctcaggagtttgcactctgcatttaaagcagtgggtttctgggcatccttgggcctcagtttcctcatgtgtaagccacagtttcctcatctggaatccattatctcgaaaggacccatccagcttgagcagtattgtgaggtgaccatcaagttccctaggcctcattttctttctttctttctttctttctttttttctttttttgagacagactcttgctctgtcatccaggctggagtgcactggcgcaatcttgactcaccgcaacctctgcctccctggttcaagcggttctcatgcctcagcctctctagtagctgggattacaggagcgccgcaccacacccagctaacttttttttatagttttagtagagacgggttttgccatgttggccaggctggtcttgaactggccaagtgatccacccacctcagcctcccaaagtgctgggattacaggtgtcagccattgtacctggcctggcctctgtttcatctgtcagataaggtaaatgattcctgccttgttctctgcccccacttttcaaatgagagaatggacgaggaaatacttggaaagtgtacacaactgtacaaatgccaggtgttatcattgtcactcacccagctcacacctgtagacaccttgagtagccaagtggaggacggcagcttcctggctaacagagtaggcagacaacagagccctgagcctgggcaggggtcctgagtgccattctgcctttgccttggattgtgtgagagctcctggaccatctgcatgtctgtgtgccctggccaaatggacagatgaaaatgacaccatgggctgctgaaatgccatgttctgaggactctaaagtgtcatggagctcctgtgtatggtatgtgaggccagaaggcagatttcatgattgctgttttactgatggaaatacacaagagatcgaagtgacttgctcagggtcatagagggaggcagtgcccatggccgaggcctgaggtctttcgatttctagctcagtccagtcccaccactgcagtatctccaagccacagcattgggatttggttgtctcacagtgaaagtaaacctgtctgcactcagatccttttctccctgttgtcgggaggtgctgggacagtgggaattgtgagactggaggtccagaggctggctgtttgctaagccatccaccaggaggctgagaagtaagcctgttgtgcctgccctgccacattccagggctgttctgttctccccgagggaatgggggcctgctttatttttagctagttcagtgtgacagccttgttctctttctgggcaaggacttggccacttttaccagtcaggaagctccctttagaacctccaggccctactcaggttctcctaggaagagggggccaagggaaggggagctgaagttggagtgccgctctgcttgctgggggcctggggcatttggcttaactgcacagccctaggttccacctgcctcatgtggggttcataacagctaccttacacattgtgcagatttggatggaggagcttagagcacccagcgtgggccctgtccacattcacgttgctagaacgtcagtttcttcatcaagaatggggatcctggctgggcgcagtggctcacgcctgtaatcccagcactttgggaggccgaggtgggcagatcacaaggtcaagagatcaagaccatcctggccaacatggtgaaaccgtgtctctactaaaaatacaaaaattagctggacatggtggtgtgcgcctgtagtcccagctactcaggaggttgaggcaggagaatcgcttgaacccgggaggtggagtttgcagtgagctgagattgcgccactgtactctccagcctggtgacaaagcgagactctgtctcaaaaaagaaaaaaatggggatcccattttcctcatgatttgttgtgcgtaaacagagttcattgaaacagaaccaacagtttacacatgctgagagacacatatgaacctggaagaagagaccgggcaaggctgtgtccccaggatggggtttttgagtgcctgagggatggttttggctttggtgatgatctcacacagacctgtcactgaggagccctgcggtggaattgattatcccagacacagttcctctggtagcttgcaggtgactcagcttgaatatgggagtgggaatcccgattatctttaggcccctctgtccctctgggcctcagccatgcagtggtgaagtgctgaggggaaggcaggggttagaagtgcctggaactctgtaccttaaagtgagaggccgctgccgggggagaagggctgggccattcggggaagtctccgggccttatctgagccagcaaaccctctgagacctccctaggctagtcattactggaggcctcccgcccagcacaggagccacccaacctggcccaggagccaccacgtggtgcctcctagggctcctgggcacacaaagggcccagagggcatggctcctgtacccctggcactcacggtctagctggcggtgtggaccatgcatgtgtccctgcaacgcccaggaaagacacacaccacgaagtgtctcccaggcagatcgactcctacatagtgaacacctaaggccgaggggatgctgaggagaggagtggacggtgtggggtggggcggatcatggcatgtgctcctgagaaggtgagttgggaggtgagctttgggaggaagaaggagctggggacggagaggcccaggaggcagactggacggggcttgcgaggaaggacctttgaggtgatgagccaccatcagggtgctgggggttagtggttgctttagggaccccactagatcagggctgcctcccctcgtggccatttccctccctgctcagagaccggctgccgagagcaggacagaaactaggttcccggctgccacccacactactgaggtggggctgggcagccgcagaagccatgtgcagtcaggaagaggagtccggggctgctgggcgggcacagaccacggtgcgggcccaggctctcagcttgctatggctgttgaacttccttcccagactgtgtgaaaggggaaggagcagatcggacagcttgttgtggctctgatcccagctggaggggagaagaggcctcctggaggtcacactggagtggcgtgcttttggcaaggccaggcagccatgctgttcttgggtggctggagctgtggcggtgatagcccctgtagtaccgcatctccctctccaggaagcccctggccctggctctccctggactgagaggatagagcacaggaccaggaatcagggagcttgctgtccaccccagtctctgcaagtatgtcgccctggccagttgaggaacctcctggccactcattcttgcccagggtgttggaagtgatggtacctgctctgcttctgcagacaggatgctgtaaggaccaacaggtaaacgcgctgtgccaattagagaggcctttataggtcaaagtcataggaacgcacccacttgacagatgggaagactgaggtgcccacaggatggcagagccagaagtcaaatgcaggtgtctacatggccccgactgtgccctgtcatcggaccgggaggggtcctgaggaagtctttagtacggctttgctagtttgagtcttagagagtgtctgcaggaaataggaagcgggaagtaggtttttaaagaaaaaagtgtttatgatataattccatttttgtaaaacaaaaagaaccatccatctctttatgtatgagtgtttgtttagggaggaagatagtcctagtacatagagctctaaagtccttgtacataaagcagggatatctctggggagactgggggaagaattaataatttttacttttatgcatttttatgatgttggaatatattttacaataagtatatattactgttattgcttcttttttgttgtttttttgagatggagtttcgctcttgttgcccaggctggagtgcaatggcgtgatctcggctcactgcaacctccgcctcctgggttcaagtgattcttctgcctcaccctcccaagtagctgggattacaggcatgtgccaccaggcctggctcattttgtatttttggtagagacagggtttctccatgttggtcaggctggtcttgaactcccgatctcaggtgatccaccagcctcggcctcccaaagtgctgggattataggcacgagccaccgcgcctggcctattattgcatctttaaaaaaaaaaatgaaacagtgtaaatgtttcaagtagttttgttagaatctttcatttgccatttttttcaggcatattgcctcccagctttagttttctaccaatgggtcaatagcattttggtagatgccttttttttttttttttttttgagatggattctcgccttgttgcccaggctggagtgcagtggtgcaatctcagctcactgcaacctctgcctcctgggttcaagtgattctcctgcctcagcttcccaagtagctgggattacaggcatctgccaccacacccggctaattttttttgtatttttagtagagttggggtttcaccatgttggccaggctggtcttgaactcctgacctctcaagtgatccacccgcctcggcctcccatagtgctgggattacaagcgtgagccaccgtgcctggccggtagatgtatttttcaggcattgagatgaaaggagttaggggtacatgattatgtcacttagggatgggagggagggaaatgacacttgatgcttactttgtttctgcacattaaaatcctccccataaccctctgaagtggaggatttattatctccatcttaaaagtgagactcagagagattaagtaacttgtccaaagtcacacagctaataaatcggatttgaacccagctctctgtccacagccctgtgtactttccaccatgtgaggaaaatggaaatgcttaaggtgaagccccaaatgggaggttacgagccctggaatctagacccagctgccatttctaaactccccaacttagcttgaatcatgggtctgtttcctctcctagataatggagataatgatgtctttcctgcctacttcactgggctgcagtgacaggagaaagggaactagcattaaagcacctgcttcctgcgtggcacttggcatccacaagctcatttcacttctttctacacagttcaaatgggataatgtatgtgaaggtcctgtatctgaagggccagtgcacatgtgagccattgctaattgtgatgttaataagcacccaggacccgttctctctgagtcagtgtccttagcaaagggaagtgaattctgatgttgaaatctctgtcctcccctaagctaacatctttcttaacccttcagggtgcacgccacaatttccttttgtaagtggagcgccttgcttggaaagttcattttaaaggcctgcgtcagcagcttcagtcacgcctgctgttctgcagcattctcgatcctcacgggagggtggatgagagagggagtgaaattttccatggctgtgcacccttccacggggtggggtgaaaatggctgggatggttaccagtggttactggtgcctcctgctgcgaccggcctgttcacttgggcatgtccaatcttgcgtttgttttttgtgcatgttctgttgggagcaggaggtggggctggggtcgggcacagaaatgtttgtgagttgattgcagtgctaggccattgagttctttccttggttggagggctctgagccagggaagcttggcgaggctgtgtgttctctgctgatgacatgtcctcctgctctgcgggggtccaactttgggagccgctgagagcttcaaggcccccttggtccacaagaaggagaatccaggacaagtgtctggaaagtgtttgagcaagagcgcccgccctgtgcagccggtctggctaccctcataggaagggctcttcactctgggcagcggtggacagaggccctggaggctggatgcgggttctcaggcaagagtctgagggacccagctcggtgtctgatgtctggtgtctgggactgggcgccttcccatttccatcccagcctgaccagactgaccagagtcccacatattcgtctcagacactggtttgagagggagcatttgagggcctgggtttctgtcatgactcctgggaacctctgtcttctgatagatggtccacagaccgaggcttgcagtggaagcagctggaagtggtgctgtgcggtgtcctccccaactcccaaatggagtgtggggagggattcttcgggcactgatgtttggctggagcagtaaagcagcggtgatgtggaggcagcacctaagagaaggggacaggattatggagatgtgagtgtgtgtgtgtgtgtgtgtgtgtgtgtgtaagtacttgtgtgtgtatgtgtgagtgtgtgagagtgtgtgtgtgtgagagattgtgtatgtgagagtgtgtgtgtgtagagagagagggaagaggggaaaaggaaggaggagagtaaagatctggagatgctgtggagaggaggacagaaatagaaaagttgaaaggccagactttggccaaatccccaaagaccaagagtcagcctttcttcctgggtttctggcagagatctggagcaactgggcaggagagatttctccaatgccctttcttcctccctctctccttcaacccactgcccattcccagcctctttcccagggagacaggcgtggtccagtggagtgccaggaggggctggtctgaacgaggaagatgcgttttgctcagtgaagtgctgggttctctgggcccctggaagttttctgcaggtgtctctagtcatgtgcttttctccagtgcctccgggccacttaaaggcccacagtccagaggggcatgtctgctgagtcctgcaccaggtgcctgcctggctgggcagtgtggcagataccagggagctgacttctcccctggcagcccagccccaggcctagggtatttgctggttcagtggccccttctgatctcccgaggaccagtggaaagaaagggcttcccttcattgtcctcattcatgtaaaatccaggaggccccagtttcagttccggccttgcctcaattgggcctcccttttggccccagtattcatgtctcttctgagaggggttgtacctcatgacgactcatgaacctgaacaaaaggaggaaaaccctccctccatagcagcttgaggaccaggccgttctctgtgtctgcagcctgctttttgatttgagcttctaagctttatttggatttagcttggttgtcctgaaacgttggggtttttggatcaatgtctgtgtgctgagctgcaccttgacttagaaggcaggatagctgtggagttatggagagctgccttttctagaagcttctcctgtccagcgggaaaaccccaacagctctacttggatctgccttctgcagagcaggggaccagtctttcttaaggggcagggatgattgtatggaggagccttagacttgcaggtataaaacctcactcccccagctgtgtgctttgaactaatcacttagcttcttggaccatcagtttctgtgtctgtaaaatggggattaagaacatctcccagacagttttgaaggttaaatgacatactggatcttgatatactgatatactgtaagccacaagagaattatatagtattattccaggatccagcattgtttgaattcctcctttgtgtcaagcaactgggtgagttccaaaggtctattcaatatgttttctttccctggggaactcacgcagtatcataggagatggacagcttggtaaaaggataatcatgatgtgtgaggagtgtggtcgttggggcgtgtccaaaatgctggagtagcaatgtaccttttttaaaattaaaattaaaaaaaattttttgagatggagtcttgctgcattgcccaggctggagtgcgatggcgcgatcttggctgactgcaatcttctctacctcctgggttcacgcgattctcatatctcagtctcctgagtagctgggattacaggcatgcaccaccatgcccagctaatttttgtatttttagtagagaccgggttttaccatgttggccaggctggtcttgaactcctgacctcaggtaatccactcgcctcggcctctcaaagttctggggttacaggcatgagccattgctcccggccttaaaattaaaattaaaaaatattttagaggtgcgatatcactatgttgctcaggctggtcttgaacttttgggcctaagcaatcctcctgcctcggcctcccaaagtgccaggattacaggcatgagccactgtgccagctagcaatgtagcttttattgtatgatcttgcgcttgctcctccattctccacgcagcagacacacaactctcatcatggttgtaatcagtaaagccgtcccaaggctcgctgtgctgtgggatcccgcttgtatttgtttatgtggctcatcaggccctgtgtggttgagctctggacagtctttccaggcacaccgtctgcttgttcatcacaaaaaccaccctccctccccttcggacttcacacatgcccttgcttgtgcctgggcatgctctccaacttcgcctctccaggaagccttctctcccatgcttgcaacgtggctgtctctccctgcagacccagggcactatgatggcaagggctgctgatgaatgccaccagccagaatagggcatggcttgtctctcctcccagggccatgtttttggcaattttatttcctttaaaaaatatatatacatatttctttctttcttttttttttggagactggatctaagtctgtcacccaggctggggtacagtggcaggatcatagcaccctgcaacctctgcttccccagctcaggcaatcctcccgcctcagtctcccgagtagctgggactacaggggcgtatcaccacgcctggctaatttttgtatttttttagagacgaggttttgccaagtttcccaggctgctctcgaactcctggccccaagcaatctgcctgccttagcctcccaaagtgttgggattacaggtgtgggccactgctcctggccaattgttaattttttttttttttagagacagtctcactctgtcacttaggctggagtacagtggttcaatcatggctcaatgcagcctcaacctcttgggcccaagtgatcctcttgcctcagcctcccgagtagctgagactacaggtgtgcatcaccatgctgggctaatttttattttttgtagagacagggttgttgcccaggctaatctcgaactcctgggctcaaatgatcctgctgccttggccttgcaaagttctagaattacaggtgtcagccaccatgcctggcctcttctggcaatttctattctggctcttggtggttcctgattgcccttctttgagctgctttattgtaaagggaaaaaggtggtagggctagtggttaggagtgggggcaaggatcatccttgggcgcagagagtgttggcagacattttgggaggcctaggtgggtggatcacttgaggtcaggagtttgagaccagcctggccaacatggtgaaaccctgtctctactaaaaatacaaaaattagcagggcgtggtggcgcacgcctgtaatcccagccactcaggaggctgaggcaggagaattgcttgaacctgggaggtggaggttgcagtgagccaagattctgccactgcattccagcctgggtgacagagatagactatgaaaaaaaaaccaaccccaaaaacaaacaaacaaacaaacaaacaaacaaacaaaggaaaaaacaccagtgttaaggtcttttcagccttgtggggctgtaaatctgtctctctatccagtgggagccttctgtgtgcaaggctccatgtgaggcactggggaggtcagggtgacacgcatggaaagctgggatccagaccagaccctgcctaggggtcagtgctgaaggagtggtgatatccagcctgaaggacttggacatcttcaggaggaagtgacagttgatttgaaccttgaaggttaggtgagctgggaagaaaaggaagggcatttcaggtagaggtgacagcagaaggaggagagcctggagcacctactaggaatggtagaggtggtttggccggagttcagagagcacagagccacacctgcagagggtaggtgccttggcagtggggaggcattgcaaggctttgggcagaggcatgacttgattagggttgcactttaagaggctgatgctgcagtggtgtagaagatgggttggaaggaagagattgaagataaactgttacagtggatcatcagcaatccaggcacacagagcagcagaaagagtggatggtgaaacaaaagaaccttcctcggtggactctacagggatagtgccatcaggacaggtgtctagctcaattctaggcacctagctggtgcccagtgaatccttttttgggagaataaatgcgaagatgccatgaaggacaaacaattagtgatagccagtgacaacccagggtgcctaaggttaggagcctgggcagcttgaggagaacggggaactcaggaagaggagcaggttgggtcaggcctggtgaagggtgggagtagtttgactcggaggtgcagggcccatggcctggcacacaggcccggcacatgggtatgggagcccaggggctgtctccattcattgaggctgggtttaaggtttctgtgctctgggcctgccaccctgtgttctcagaagggtcctagccctttggccgccatttctgtctttctagaagtcttgcccatggacacctgccagtactactgtctcatgttaataataatagctgatgtttattgagcagttactgtgttctaagtgcttgtgtctcatttgaacttgtcctatatgttaggtcctatctatcatctcagtttttcagttgaggaaactgaaattcacacagctgttaagctctggggctaggattgaacccagttggctggctccagagcccttgttcgtagcctctctgtcattcccatcccagtgagagtgagccagccaattctcagagagagaaggaggcttgaggtgttcctgatactggaggaaacctacctccatcaagtacttgggggttgaagagcagcttccatgtcatatttgagggttggaaaggatcttagagatatcgggttcattttacaggccaggaactagggctcagagcatttgcaagcctgttctgggtgacatggatgacagcagttgaatgaccttccgccatgcgatgtgccagcgtgcgtgttcctgtgcctgtgggagctggctatctcagcgggtgggtgcctcaccttgccctgtcctccccctcgacctcactctccttccttctcatccccctccagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctggtaagtctgtcacccagagattgaaccctgagggctaaatgttctgtgaaatcttccttctaacttcatttgttcatacatttgctcattcattcattcaccattccatcaatctgctctcccatccatccatccatccatccgctgatccatctgctgatccatccatccatccatccatccgctgatccatccatccaatatgtgtctactgagaccttatgccagtcactggggataccatggttgggcaaggctgacctgctgtcattgactttactgtctagtggcttgtgatactttagaaagtgtagtgtttatgggtctcgcagatactgtgtgggttgctcttatgtcttcagaacatgaagaactccagaacaaatgaagggttcattttagggaaatctctccatcagggaatcaaagcttccctctcttcttatcccagataatagcaatcctaatggacaggtgggtctcagacttaaaggcagagattccagaccccctttggacagatttcacagatgcagaattgaggcagcccccaaaacaaagaaatacagaggggaggtagaattgaaagaaaaattgtatcctttcactctgcatcctgtggctcataccctgcagtggggcgttgggggagggccccctgaggattgtctgtttctcctccccagaggagtggtatcagcccctgcacctggctgagcggagactgagaagtcgcagtctggcctgctcagtggaagctgttcttcccggcagacccgcagttactagtttgtggaggtgaatgctgtgcttgctccagcgtggcgccctcacaggaatcccctgttagctgtgttctgtgctctagggtggggctcacctgctgtaggcagcagagggagggagagcaggaggaagtcaggtttcccttggggttgtgagtacacgaccagtgagtacagctttcacacacccctgcgatttcttccctgctctcgaggctcttatttaaaggagtgatttggggcatcttgtatgcagcctgcaaaatggacgccaggaaactgcagctgttgcaactgatgttcttgaaagatgggcaagtgggagtaggctggttgcagcaggaaaagacctctgctctctgcctgcagtcatcctgaatgagatttggacgctgataaagaggccttgtgctgttcactgtggccacgggtggggtctacttcatgctcacatattagcatgtatatctctgatgtaagcctactccacctccacccttttgtttaggtgttgattactagcacctacttctagctttttaagaactactgaagagattctggccatcagagtgaatagactgtggtctaccctgggtgtgttcgcttgtctctggctggagaagaaagaactttatatatagttcactcttgctttttcccagccatggatgtcacctacagccaggagcactggaacctttccaggatgaggagagctatgtagcagaggcatggctctgactgcttccagctgagagaagaggaaggagcggggaggggagggggtatgggcagcacccaggagagcacctgctttggctttgcttgggagagctcagaaggctacctgatccctgcgaggcacctggccctgtgtgactggctcagggcagacacaggggaggagacactttgcctcctacccactgggccctgctctcaagccagctgtgtcccagggacctatgtcagcaggggtgctctccctctccttcacaaactgtttccaggattgagagtctcaaggtgtgatccaagtgcagtagaaatccagccatttgccatattggctactcctccaaacaaggcttagaactcatactcatttgtgaaatgtatttttcacccccttttagagattcatagaaacggcacccccccattccaaatatttatgggtgggttcagttcatgtgccccagagcccacacttcgcttgcaatggtccctacagccccgcaaagacattgctgttgatgctaaggacttggatacccaacccccagtccacttcctgccccttcgtgttgtgccgggcttctgtcttcacctccccctgcctcttggctcctttatcatccaagaatcaggagatccctgcagtaatcagaatctgggtctcttaatagtaaatccatagtgctgttccctttttgaaatgttaatcactgcttcaactgtagtaattagtgacagaattagtggtaatcccaaaccacggagggataaattggcgctcaccatggtggagcaatgcctaagtggtgatgtgatttccaaggcaaaggaaggaaacaagcctttcctttcttgctgaccttgaccctggtcgactagacacagagttttggaactcaactgactttccagaagcatttctgaaaacatatctgatacatacattctgatacctatcagcccatttttaattagtttctttcttttttggtcattttttttttaatgggcagtgaggtttttgtttttggtattttgtagagatagggttttgccatgttgcccagactggtcttgaactcctaggctcaggcgatcctcccacctcccaaagtgctgggattacaggcgtgagccacctcacctggcctgtttttatttttattttttagttgttcttcaataatctgtatatcattaaaaaaaccccaaaaacctaaagtggctttttgctgctgcatatcatttttgaggtagtggatgaatgaataataaagaaggaaaatattgaagcctcttaacattggtgatttggctaaatagaattccctcttcaaagctactgtagggagcaagggaaaacgtcccctttgccctctgaatgttggctgaaaaatcagctcacaaaaggcagattaataggagaaagggcatacacatttattaacatgcatgtgggagaatcacagactgattactcaagtatcccggtggggcccagatacttacatttcctcttttcttttcctttttttttttgagatggagtcttgctctgttgcccaggctggagtgcagtggcacgatggttcaagcgatcctcctgccttagcaccccctacgtagctgggattataggcacctgccaccatgcccagctaatttttgtatttttagtagagacggggttttgccatgttggccaagctggtctcgaactcctgacctcaggtgatccacccgcctcggcctcccaaagtgctgggattacaagtgtgagctactgcgcccggccacacatttcctcttttcagaggggaggcaggagacagggaacagtaaatgattactagggagaatgaagatatcagggaacagagattaaccagtaccggttctctttggaaattgaataggagacagattttttttttttttttaagacagtctcgctctgtcgcccaggttgcagtgcagtggcatgatctcggctcactgcaacctccgcctcccgggttcaagcaattctccggcttcaacttcctgagtagctgggattacaagtgcgcaccaccacgctgggctaatttttgtatttttagtagagacgaggtttcaccatgttggccagactggtctcgaactcctgaccttgtgatctgcccgccttggcccctcaaagtgctgggattacaggtgtgagccaccacgcccggtttaggaacagacatctttaaaaaggtccattcaggtgtggtcagattcttcagtcttcttttctgcaatagataatgagataacagggagggtaaggataaagttctccttggagggtctgcgtggtctttatgcagataggagaaaagcattttccagcatctgttgatctttaagggcctttagttcaaaatactcattataccagggagccatattttggggtgaagtattttgggtttccctcactacccagtctcttgggaattgctgtccctctgtgcccagcctcccccattcgcgaagtgtcccttttttctccttttctcatttatccctaaggatattgtaagcactaattagagtgtaagcttttggaggctaaataggaatcgatacttcttggtttcggcttcattgttcctacacagcctttacccaaaagagaagtttttacccaaaggagaagtaaaaaaaaaaattttctagaagcttggatgtgccattatcttttttcatgcaaagcagagccatttacagtgtagtcacggttgttttggggccctaaatattcatactactgttttccagtcaacggaaggaaaatatttaccttctcttcttgcagcatttgggtggtctcagttttcttatatggaaggatagttgggttatctcaagtattctctctatctgtgaaacctcctgagttgaaggcgtggagttcccatcatgcagctggattgtagatgggcaggaatgcctgtgtatctcatgtacagaattaattcattgaggctgggcacggtggctcatgcctgtaatcccagcactttgggaggccgaggcaggcggatcacctgaggtcaggagttggagaccggcctagccaatatggcgaaaccccgtctctactaaaaatacaaaaattagctgggcatggtggccggtgcctgtaatcccagctacctgggaggctgaggcacgagaatcacttgaacctgggaggcagagttgcagtgagctgagatcacgccactgcactccagcctgggcaacagaaactctgtctcaaaaaaaaaaaaaagaagaatcaattcattgagctggactcaggcaggcatttcccgcaggcagagtttttgcttgccctgtattccagcacaggctggtactcgagacacatctgtcctgtgtttgttttccattatttgctggtaataatggctgtcattagaaagtggagaattgccagtagcccttcggatgtgttgtttaatgagctttctcttgagcggttctcccagcttcagtggaaatgagaaatgtgaggaaaggtcacaggcaggaggccccagtagcaggaagcaaggtttgagaccaaagattgaaagaggaagttgggaggaaacctattactgcagaaagaggctgagcttgtagccaaagagaaaaggaaataaaaatctagaacactgaatcggtctctgggtttgccactcccaacctgtgtgaccttggagaagccacttaacttctgagcctccatttcctcatgggtaaaatggccatggtaatccctgccccacctgcctcaccaggctatcatcaggatcaaatgagagtctttggaaactgcaaaccaccgtgagttatggtgcgtcatcgtcatcctcatcagtcttatgatataataactggctttggaagaattccttgggaaagtctttcctaaccaatggagccagtccaaggaccgcacccagcaggcctgaatgtgtaagccgagcccctgcaggaaggatgcagagtttttcaggattcgctggcatctctgtgatgttacaggggaaggaggcagagaaaaggggcaagccaaggcaggctgtctcacccccaacccctgagctagccacataaaatgtgggtgagaccacaggctacagctccagtacctctgcaagggggtgactggacacgacagctctgaatcagggagccaacccgaggtaaaagggactgataggtcccttttgttatggagggcaagtgggtatttgggggattcatttcctgacaaagaatattgaactaacctggaaaccttctggttgtagctgaaggaaatctgactcaaatttgtttaagaaaaaaagagaattctagtttcctataactgggaagtctcgctgtgagttgacttctgtatctagggattcatctgtctcttactagttcagtcagctcctttcctgtgtgttggcttcattcataggccatctctcctcttacagtggcagggacggcccctgcagccctaggctgacccctccccttatagccagcgatctctgtgcaaagagcaggccttgctccccatggacctgtgatggtcttggagagggctgtgattggcttacttgggttatgtgcccatcctgaaccaatcacgatggacaagatgggtgacttgggatgcccctggatcccatgcctggattacgcattggtacccctggagctggagtggggattcagccccacttccaacctcataggtgaaaaatgggagggtagttatctaaagagatgctggacatccaggaaagtttatcagttatcttgttgtccttaacagacatcattcctcagtgtcttttgcccggcagcgtataggaccagcactttgggaggccgaggtgggcggatcacaaggtcaagagatcgagaccatcctggccaaaatggtgaaactccgtctctactaaaaaatacaaaaattagttgggcgtggtggtgcatgcctgtagacccagctactcgggaggctgaggcaggagaattgcttgaacccgggagttggaggttgcagtgaaccaagattgcgccattgcactccagcccgggcaacagtgtgagactccatctcaaaaaaacaaacaaacaaaaacatgaaataaataaatgtttaggtgaacattaaaacagcaaattaattaagtaaaatattaaaataaaaagtaccgatcatttcatctcagtgtagtatttgcttttgtgccccttttccccctatgcacaagtggtttatagttgtttatcagactgagctttcactgtcttcattagagaatgaagcaaaataaaaccaaagctggccgggcgccgtggctcacgcctgtaatcccagcactttgggaggccaaggcaggcggatcacgaggtcaggagatcgagaccatcctggctaacacagtgaaaccccgtctctactaaaaaaaaaaaaaaaaaaattagctgggcgtggtggcgggctcctgtagtcccagctacttgggaggctgaggcaggagaatgatgtgaacctgggaggtggagcttgcagtgagccaagatcacgccactgcactccagcctgggcgacagagcgagactccgtctcaaaattaaataaataaataaataaataaataaataaataaaaccaaagctaggccaggcacggtggctcacgcctataatcccagcactttgggaggccagggcagtcggatcatctgaggtcaggagtttgagaccaacctggccaaggtggtgaaacctcgtctctactaaaaatacaaaaaatgagctgggcgtggtggtgggtggctgtaatcccagctactggggaggctgaggcaagagaatcgcttgaaccccggaggcggaggttgcagtgagccgagatcgcgccattgccgtccagcctgggcaacaagagtgagactccgtctcaaaaacaaaaacaaaaacaaaaaaaacaaaacaaaaaaacccaaagctataaggaatcatggaagttgaagagccccagaaaagaagtgtagccattcctgatgtgctgaagtctctctctggcccccactttccttggggatccttgtccctgagttctgtccaggaggcagttttcatggttatacattatggcttcggattcaaatgctgactctgccacttactggttgtgcgtttgggcaagttatctaacccctctttacctttacttgctcatctgtagaatgggcatcctgacagtactgacttcatagggttgtgaagattgaaaataaaaggatacgtataagcacttagtgattggtacagaaagactcagtgaatgttagctgatggatggtcaaataaaatgtttctgatattctagtgactcacctgcgaggagctacttcatactgaattcaattttttcagttatttcaatttttttttttttttgagacagagtcttgctctgttgcccaggctggagtgcagtggcatgatctcggctcactacaacctccgcctcctgggttcaagcgattctcctgcctcagcctcctgagtagctgggattacaggcacctaccactacacccagctaatttttgtatttttagtagagacagggtttctccatgttggccaggctggtctcgaactcctgacctcaagtgatccacccgcctcagcctcccaaagttctgggattacaagcatgagccactgcgcccggctgaattcaattttttaacctagtggtggtgtaaagtactgttggagttaggactccaatgggagcccaaagaaaattctatattgatttgaacaatgccacaaagtcggggtcagaatttccaccaaatctatgacacctgcttcccagcattctcccttgttctctctctttcctttggaccacaaataatttaaaaccagtggcttcatgtgatatatacatataatggaatataatcggttcataaaaaggaatgaggtactgatccacgctacagcatggatgagccttgaaaaccttatgccgggtgaaagaagccagacacaaaggacctaatattatacaattccacttatatgaaatgtctggaataggggcatctgtagagcagaaagtacattagtggttgctgggagatagggaggttgggaggaaatggtgaatggttgttaatgggtatggaatttcttttgggatgatgaaaattttctaaaattagatagtggtgatggttgcacaactctgtaaatatgctgaaaaccactgaatttttcactttaaaatgggtaaaaattgtatgctatattattatatctcaataaaactgttattaaaaaaacaaccaaccaatatgtgaaataataagaaatatacatgttggtctctgcccctagtctctagcatttagcttctaaaacccttgtaatttcttgagcaatacaggtgctaggagaatctttgatcctggtcctgactcagagctcctaaatcccttggaatttcttgggtgataggagagtctcttttgttccttggtgggaccctggatagcctcaggatggggggctggttgccagggggaaccaaccatgtgatcagagggttgctgtcagccccaacccccatgccgcctccagggagggagagagcctgaaaatagagcgaataaaccaatggtcgatgatttaatcaatcgcaactgtgtaatggtgcttccacaaaaacctaaaacaggccaggtatgatggctcacgcctgtaatcccagcattttgggaggcccaggtgggtggatcgcttgagcctaagagtttgagactagcttgggcaacatggtaaaaccctgtcactacacaaaatacaaaaaaaagttagccagatgtggtggcacgtgccggtagttccagctactcgggaggttgaggtgggaggatcgcttgggctctggaggttgaggctgcagtaagctgtgatcatgcaactgcactgcactccagcctgggtgacagagtgtgaccctgactcaaagaacaaacaaacaaaaccaaaaaaaaaaaaaaaaagcaaaaagaagaaaacctagaatgactgagttctggtagcttctgtctagctgaacacatggaggttcctgggtggcacatctggagggggcatggaaactcctgccctttctcccatgcccctccctgtgtatctcttccatccagttcttcatctgtatttattgtaatatcctttatagtaaatatgtaaatgtaagtgaagtgttttttctgggtctgtgagctgccgtagcaaactaatgcaacccaaggagggggttgtaggaaccccgatttatagtgatcagccagaagcacaggccacaacctgtgcttgtgactggtgtctgaagttggagggagggcagcctcgtgtgaacgagccctcgacctgtgggatatgatgctatctccaggtagctagtgaaataattgaattgaattagagagcatggagctggtgttcactggagaattcactgcagaattacttgcttggtgtgtggggaaaaacccacatgcatccagggtcacaggtgtgttctgtgttgtggtgagtagagaaaaggaaaaacatactctggtttttcctctgtgtgtgtctcacatgatggcgtaactgctttgtgcttaataaacagcaagcaggggtgctgtattagtccgttttcatactgttaaaaagaactgcctaagactgggtaatttataaaggaaagaagtttagttgactcacagttcagcatggctggggaggcctcaggaaacttacaatcatggtggaaggagaaaaggcatcttcctcacaaagcggcaggaaggagaagtgctgagcgaagggggaagagctccttataaaaccataaggtctcatgagaacccactcactatcacgagaacagcatggggggaaccacctccatgattcagttacctccacctggtctctttcttgatatgtgggcattgtgggggttacaactcaagatgagatttgggtggggacacaaagcctaaccatatcaggtgccttgaatgaatgaatggaccaccagtccctgtgaccaggcagctaatgagcatttgctgagctgtcctgggtgccaaggacagagaatcccaagttgtggtctttccctcaaggaacttgagaacgaagataggaacaggctgggcgcagtggctcatgcctgtaatcctagcactttgggaggccaaggcaggtggatcacctgtggtcaggagtttgagaccagcctgaccaacatggtgaaaacccatctctactacaaaatacaaaaattagccaagcatggtggtggacacctgtaatcctaggtactcgggaggctgaggcaggagaatcacttgaacctgggaggcagaggttgcaatgagccaagatcacgccattgcactccagcctgggcaatggaggaagactccctctcaaaaaaaaaaaaaaaaaaaaaaaagataggaacagtgacattcaatgtgagaattccttggtttgttgtttatttctttataccttcattaattccacaagtatttgctcagtttttacctacattccaaacaccattgtaagttccagaaatatagcagtgtgtcagggcttatagcttggtagaatcaaatacaaagataagtcagctttattgttaaaaacagaaagcaaaccttattttgtgttgaaaatcaaaagctcaagggacccagaataaccaaagcaatcatgaaaaagaagaacaaagctgaaggaatttcactgccaatttcaaaattttcagcaaagcaacagtaatcaagacatgtggtactggcatgaaggtagacatgcagactaatggaacagaatagagagttcagaaataaatgcatacaggctgagtgtggtggctcatgcctgtaatcctagcactttgggaggccgaggctggtggatcacctgaggtcaggagtttgagaccagcgtggccaacatggtgaaaccccgtctctactaaaaatacaaaaaaattagccagttgtggtggcacacgcctgtaatcctagctacttgggaggctgaggcatgagaattgcctgaacccgggaggtggaggttgcagtgagccgagatcatgccactgcattccagcctgggtagcattccagcctgggtaacagagtgagactttgtctcgaaaaaaaaaataaatgcatacattacggtcaattgacttttgacaagaatgctaggactattcaatgagggaaagaatagtcttttcagcaaatggtgctgggacactggatatccacatgcaaaagaatgaagtttgacctacacctcataccatatataaaattaacttgaaatggatcaaatacctaaatgtgggagctaaaactaataaaactcttagaacgaaatacaggtttgaatctttgtgaccttggatttggcaatagagtcttagctacaactccaaaagcacaaacaataaaagaaaaaacgtaaaactggacttcatcaaaatttaaaacttggccatgcttggtggctcatgcctgtaatcccagcactttgggaggccaagcaagaggatcacttgagcgaaggcatttgagacagcctgggcaacatagtgagaccttgtctctaaaaaaaattaaaaattagccaggtgtggtcgtatgcctgtagttccagctacttgggaggctgaggctggaggatttcttgagtccaggaggtcaagggtgcagtgagccatgattgcaccattgtactccagcctgggcaacagagcaagaccctgtctcaaacacaacaacaacaaacataaaatgttactgcatcaaaggataccataaaaaaaagaaaagacaatccactgaatgggagaaaatatttgccagtcatatgtctgataaaggatttgtatctagaacataaaaagaacttttacaactcaacacataaaagacaaatgaggccgggtgcggtggctcacgcctgtgatcccaacactttgggaggccgacgcaggcggatcacaaggtcaggagttcgagaccagcctggccaacatagtgaaaccccgtctctactaaaaatacaaaaattagccaggcgtggtggtgcacgcctataatcctagctactgaggaggctgaggcaggagaattgcttgaacccgggaagcagaggttgcagtgagtcgagattgagccactgccctccaagctgggcaacagagcgaaactccatctcaaaaaaaaaaaaaaaaaaaaaaggaaaagataagccaagtgtttaaaatgagcaaaggatctgaatagacatttctccaagtggccaataagcacatagaaatgtactcaacaccattagtcatcagagaaatgcaaattgataaagaagtcagactgtaataagtgttgatgaagacatggagaactgaaaacttcatgcattactggtaggaatgtaaaatggtgcagctgctttgaagaatggtggtaattccttgaaaagttaaacatgggttactatttgacagcgattcttgtcctaggtatatatacccaagataaatgaaaacgtgtccacacaaaaacttgggcacaaatattcatagtagtgttattcataatagccaaaaggtagaaacaaaccaaatgtctgtcagtaacaaatgaataaataaaatgtgttatatctatagagtgtaacagccattaaaagggataaagtctcatatgcactataacatgatgaaccttaaaaacattttgcttagtgaaatgagccagtcatacaaggtcatataccgtatgatttcttttcttctttttttgagacagggcctcgctctgttgcccaggctggagtgcagtggcgtgatctcagctcactgcaacctctgtctcttgggctcaagagattctcctacctcagtctccaagtagctgggattacaggctcacaccaccatgcccatctaatcttttttgtgtttttggtagagacaggggctcgccatgttgcccaggttggtctcaaactcctgagctcaagcgatccacctgcctcagcctcccaaagtgctgggattacaggcatgagccaccgcacctggccactgtatgatttcattgatatgaaatgtccagaagaggtaaatctatagcaacagaaaatagattagtggttgcctagggctggagaaggatgaggggcttgggaggtgatagttaaagggtatagggtttctttttgaaataatgaaaatgttataaaattggctgtgctgatggttgcataactccgaatatactaaaaaccattgaattgtatactttaaatgggtgaattatatggtatgtgaattaaatttcaataatgctgttacataagatataatgataaagatctttccctgcctaggaaaatgatatgccccaaagcagtctagtatttactgccataggattgagagcttggtggatcatgtgctgtggaaggcaggggtggccgtcacccctggcgtggtagatattaggacagtggggatgtcaccttagcatcacgagtgaaacatatcttaactgatttttctgggagcatcgtgaggataactaatgagatgaagggtagagaatgtttggctgtggcttaatggttggaactttgcccatggccgcctgcctttgctgtccgatggtctcagcctacagtcctgctctgccccctgaggcccaccccagtgctgcacatgtcactcccgagggaggtaaccatagcagaccagtactttggccactggtacttttatgtgaccaagagggacttctgttaaaagcatcctctgggtggaaacaacccaagggtccatcaacagatgaaaggataaacaaaatgtagtggatccatacaatggaatattattcagtcttaaaaaggaatgaggctgggcacggtgactcacgcctgtaatcccagcaccctgggaggccaaagcgggtagatcacctgaggtcaggagtttgagaccagcctggccgacatagtgaagccctgtctctactaaaaataaaaaaaattagccaggcatgctggcggatgcctgtaatcccagctactcgggaagctgaggcaggagaatcacttgaacctgggaggccaaggttgcagtgagctgagattatgcctctgcattccagcctgggcaacaagagcgaagctctgtctcaaaaaaaaaaaaaaaaaaaaggatgaaattctattgggggcagggtggctcatacctgcctatagtcccagttacttgagaggctgaagtgagaggatcttgggagcccaggagcttgagactgcagtgagctttgatcacaccactgtactctagcccaggtgacagagcaagaccctgtctctattaattaaaaaaaaaaagagtaaaattctgaaaatatggatgaaccttgaaaacgttatgctaagaggaataagccggtcacaaaaggacaaataactgtgtgattcttcttgtatgaaatatccagaataggcaagttcatagagacagagagtagaatcgtggatgctggggactgagggtgaggggaaatggaaattattgcttaatggttatagagtttgtgttggggtgatgaaaaagttttgaaaatagtggtgatggttgcacaacattgtgaatgtacttaatgctactgaattgtacgcctgaaaatggttgcagtggtaaattttatgctatgtgtatgttaccacaataataaaacacaaccctgaggagtaagcagaaccctggaataattgatgtcagagctgacatgcagagacccagggcaggcactgggtggacctcagatgtagggctttgtctgagttgaaatgcggtgtgattttttatttctgcatagcagtgctgtttttgaaataggttaagaaactagagaaacatggggtgggaatttgtacttaattcagtacttccattcccctatagtcagaagtaagagactgggattgcttgaagctatttctgtctaaggactctggggtaggatagggtttcttttgcctactctgcgtatatggcagtggttggatgaagtttgcatgattgctgctttctggctgataacagcatgtggcagggggaggcagacagggcctacgccctgccaggaagcgggcatggtatgtggcttccccttaacatttgaatctcatgtgatacctgttgtctccctaaacagaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccaggtgggtccctgctccctccgggtcaccccgtcgggccagcatccccttggttacctccaggaaccaggcctcaaagcactggcatcccaagcccctggaagagggttgctggaaagagtccctcatagatgcatatgtaaaaggactcctgggcagaggatgtgacagcctgcatgggggccctgcttaaacagaggctctccgtctgggcaaactggtgtagtggaagtgggctgcttggactagcagagtctgggtttgaggagggaggctccgcagctctgttgggtaaatgcactcattccctgtggatcctggggtcggttccccagtgcaggtttagcagagccctgggtgaaaatgcccttttctcctggtcattggcctcacccacttactggaggccccggccttgtagggtatggctgtggccttgtcgggcaggaatgaggtctcacagctctgggctatttgggggcttcttgttacctgatttagaataccattgcacaagcccttggcacagaaagcagaggaagcagggaaatcacggtcccctccttttacactcctgttggggctccccacgctgggcccccaggaagggctgcccttcctccctgcccaaggggctgtgggcatgcctaggaagggcctgtccacctgccccctcctctctgggtgcggggagtggtgggtctgtagctcactgaggaccctgtgatcagggctcaggcagcccactgcaggttttcagtcatttctgggtccctaagcccgtcgtggggcaaggtgcactcctcctctctcctgtagacattctggctcctccagtctggctcgcctcctgagttgtggctgctgtccagcatatgtactcagagctggccaaatgtttgctttaaggagggtgtgctcaccgcaaggttcatgactaagatttccagggaactctggttctggggtggacttcgagatgagacccaggagccttctcttgactctactgtgctcttaagttcttgtgggtgggacctggagcaagccaccaagccttttctttgtccaagagacaagggctaatcctggctaacctgctccctgggatttgggttcagagcccttcagattatgtcacagtgagtgtcacaggtgacactgtcactagagcaggtgagccactttatagtaggccaccaaagctgggtgcatcactactggatggccctgcccaagggctcccctgctactcccattactggggctgcagagactggcccatccatctggcgcctgcacaaaggctgccagctggtaggtctcttgaccatgcccagttggctgctgcattgcttctccttgcaggtggccagcagcccatggtttggcatcctgcactttctgtttggaacacacactggcctatcactctgtttcccaaggtccttgggttgagctacctaagcctggcgcattcaacactgagactcaccctgtgctgcaaacattccctgtgtgttttacaaacattccctgtgtgttttggcttgaccttttaggagcaaggtttgttaattaagggagtaccctcaccttcttaccactgccctcttcgtctctcccagcctctatccccatcgtcccctcttctcagtcctagaatcactttatttcctactgtctctgtttcttcctctcctccttttaagcagcctgaaaagaggatgatgacgataatcatgataatgtagtaccattatagcaaattcttttttttcttcttttttttaagacggagttttactcttgttgcccaggctggagtgcagtggcgcgatctcagctcaccacaacctccgcctcccgggttcaagtgattctcctgcctcagcctcccaaatagctggaattacaggcatgcgccaccacacctgactaattttgtattgttcgtagagatggggtttctccatgttggtcaggctggtctggaactgcctgttcaggtgtgagccaccacacccagcccagagcacttttaagctttaataaattcagaagcacaaatggaacattcttaaaatatcacttacttagttgtgggaattttgaatagtaaatgttttaagtttttgtattagccatcatttgccatctttaataagagtgactgagtctttatttttattttaaattattaaaaaaatttttttttaaagatgggatcttgccaggttgcccaggcagatctcaaactcctggactcaagcgatcctcccactttagcctcccaaagtgctggattatagatgtgagccactatgcctggccatagtgtgtgtatttctcaaataaagagtgtgttgtcaggcaagaagagaaaataatgtttttttttttttttttaagacactaaagctttgagttcagagcggttaggtgactttttttcctggttgatcgcagacatagtctagcctggggcgggtcacttcctgcctctttgggcaggcttgtcaccctggatcaccagcactccagaaacggcctttccttctcaatggtgcactctggggagttgtgtttggcctggatccgggaactggtgacaggtcccattcatgggaatccatttgagttctgccccttcctgaggcagccttcccttcacccggccttctctcccgaggctgcaggagagtctggagcctccgagtgcagatggcgtggggcgccaggaccaacttagtaatgagtttatatcagtctgcaatgtaggtcgcaggaagcttagccggcttctctggggagggtcatgtgtcaactcagcctaagatgccagctgctctgcagcctgagtaatagtgactcagggatagaaggtcctacattaaaattgaccaggcgttctattactctggcaacaaagtccgactttagagctggcttgggggggatctggggaaagatgggaacagcagtaatgacttctggccccctcatgaggccctgcaagtaaagccttcaggcagctggccttgtctgggagttcgggctggggccacttcatgtgactatggtttggctctcctaagacagccttcttctgggttccaaaaagctccatggctgtgtcactgccatgtgtaagggaggtctagtgtcatgagagtcatgtgaaagagacaaggggttagctaggctgtggcatggctgccaaaagtgtatatatatacgctcaggttggattactagaggcagagagataaagaagggaggttcttagttctactaaccactcttctggttagaacacacatagaatattatcttctgttctgattatattttgagacagggtctcactctgctgcccaggctggagtgcagtggtatgatcatggctcactgtagcctcgacctcctgggctcaggggatcatctcatctcagcctcccaagtagctaggactacaggcatgtgccagcatgcctggctaatttttaagctttttgtagagaggaggtctcactttgttgcccaggctggtgtcaaactcctgggctcaagtgatcctcctgccttggcctcccaaagtattgggattacagacgtgagccaccatgcctggccctggttatattttagagatgaagggaattattagagagatccaaaaagattaccttagaggtgttgagcctctcctcatgggcagtattcatgtagaagctagggacccagtgttccaggctctttctagcagattcctaagatatgtatgtacctgataagtcatagataacatgttatagcacaggcaagcttaagctacagtgcggtagataaattgtggtatattcataccaaggaatactgtgcggcaatgagaatgaacagttgtcaaagacaactccgtggatgactgtcatccacatggtgtcgagtgaaagaacacagacaccaaagagcacacacggtctcatttccctttagacacaccaaacaaacaggcagatgtaactgagggtgatagacgtcggggtggctggcagttgcccttgggctgggtggtagcggtagtgactgcaggggcagaagggggcatattacaggtgtttctccatctcgtgtttctccatctgggtgctggttacatggatagctgcagcttgtgagaatccagtgaactctgcacttaggatgtgtgtactttttggggtatgcataagacacttcagtaaaaagtaacattatgacagtctgaattgttaagtcactccagtgggctagaggctgtggaattgccctcagagtttctgaaattttcagagagcgtggcgtcgggcggggcgggaaggccactccacctggtggctggtggagatccgtgacctgtgtgttatgaaggcatagctggttttctattatttttccatttttctcagtacccagatgttgcatattagtgaccactgagaggccagttctgttgaaggctttgaattgcttcttaagagctgtacttgcccacagggtagcttttgaaaagtgactcttctctgcattcacacacagcatggcttttcagacagggccaccaggtcccaggagtacgagcactttgtttgggtagatgtattcctttctgtgtgtgtgggagggaatggtttatatttttctatgaaatgctaagcctgctttggggccccctgactgctctcatgtttccttcagctttttgatcatgttgctgagtgcctgggagatttcatggagaaaaggaagatcaaggacaagaagttacctgtgggattcacgttttcttttccttgccaacaatccaaaatagatgaggtaaggatgttctgggattatcgggctctgcagatgccccgggatggaaaagctaacaagcccttttctccacaacttttcccctttgttggcagaatggtttgcatgtctggtatttttaaagaaacatttgcagaagttagtgtggtatcatgatatagtgtttactttttcacttaaacttcagttatttatgtatttttggagacaaatcagggtatttttggccaccaggtagacagaagcatttattaatcttaggcaagcaaaggaaaataaagtagttttaatggtggtggagagaggtgggaaagctctttgccagaattgcatggtgtgatgtttacctggaaactgccctggttactgcgaatatgctcagggccctgtccctcaggtgccagggctgcctctccatagtggagctgatcagtggctccagccccagggatgcccttggcgacctccgaggtgacttgttgtacccaccttcctgtttgtcatctatttgttttttcattcgttcattcattcagcaaggatggactgtgatgataacactgaacttcagcactgcaggaatacaaaataaatacatacagccttgttctttttttacatggaaagacagaaaccacacacaccacaaacacaaaccacccatgaataaacttctaataatatgaattctggggttgggtgcagtggttcatgcctgtaatcccagcactttgggaggccgaagcagaaggatcacttaagtccaggagttcaagaccagcctgggcaatctgtacaaaaagttagctgtgtgcgttaacatgtgcctgtagtcccagtgatgtgggagaagcttgggagatcgaggctgctgtgagccatgattgtgccactgcaccccaacctgggggacagagtgagaccttgtctttttttgtttgttttttgagacagagtctccctctgtcgcccaggctggagtgcaatggcacgatctcggctcactgcaacctccacctcccaggttcaagcaattctcctgccttagcccccctagtgctgggattacaggtgcccaccaccatgtccggctaatttttgtatttttggcagatatggggtttcaccatcttggccaggctggtctcaaactcctgaccttaggtgatccgcctgcctcggcccctcaaagtgctgggattacagacgtgagccactgcacctggccaggctctgttttaatacatacttcacaggtattgcacataatcttcaagcatctctatgagttaagtgcttatgattcccactttacagatgaggaaactgagtctcagaggggctaagaacctgtccaaggtcacctagccaggaagattccatgctcgtaactggtctactctgctgcaagttagtagcatttgggctcagggcaccttccacacttgcagggagcacccctgggtccctttatgccattagggtaagcgtcctttcctgggcactgcttcctgtggctggaacccttacatctgtaaaatctgtggaatcagcaagaaggggcttgagagcacagcaggccaagatgagcgcagaggtctccccagggtcacagggcttattaatggcaggccttggaccagggtcccaggccccacctcccatccagtgctccacccacctccaacatgtctaaatgcctccgagatgttctgtctgacctgttatgctttcaggaagctgtggccatatgtagactcttaatctggttctggtatctgagaacgcccctccaaggtgttcagatcagtttggcctccactgtgtccttccaaaccctttggcaaggcctgttttcagtacaagtttcccttggcttttgagaactgagacatgacagtcactcccccttccccttcccttgtgagaggtgggcctggaatgaagagactttggtggactgcgtttcaccgttgtttacatgtgctctctgcagctattgactgagtgccatccctgtgccaggcatgggctaggccctgggagagaatggccagagtgtatttattttgtattcctgcagtgctgaggtttaatgttaccgtacagtaggtcccgtaacagcagatgtagcctgttccccatgaaggtgcagccttctatggacagaagtgttgcaggaggtgggagggaatgacttcctgggcacgagagcctgcagggtggagcagacatgcccaagagggggcattgtgaacagagaaggagccagaggtggggggtgtccacctgccagccttcaccccctctggagaatgcttcctaggctgggccagggtacttgctgtggcgccagtggagcacagaccctcaatttcccatccagaggcctgtgcatgttaccccttagggctggctgagaacttcaagattgtccacttctagatcagctccctgtttctagaggagcacagtgaacctcagaggagtgaagggaactgcccagcaggaaatgggcagacagtatgaagtgggaccaggtctccagattgccagccccacctttgtcccacaacacctggttctctgaggctttggaggaggaagagggctgcttgagaggaggcagatagtgtccagggcttttgcagttcctgacttagcttagttgctgctgagcaaagaaccaccagttctcatcaagggctgccctccctggtgcatactccagtctgtgtggctcccaccgtgagctggggcggggcccatgtgctcagaatgctatccctgagctacctctgcaggcctgcggggcctggaccgtgaatcttccaaccctgctgcatttatagtgacttgccccattcagagtaaaacagccaagtataacaattatttttctgttctcatatctttttagtttttttttaagaaagcaaaagcaatatgtaaaactatcaaagtaagataaaattatagaatgtttaccattggatgtctatccttgatgtttctctgctaatatgcaaagtgaaataggatcatactgtgtaaataggggagtcaccacttacaaatggcggttaagtcccaaagctggtgaagaggcacaaatcatgtatagtccacatcattccctaaatgtctgggacctggctcttaaaagctcagcagccaagaattatcttagcattttgtttctttttccaatttggctctggctttcttttcccagggctgtggaagccggggtctggttgggaagtggggaagggggccagggatttctcttgctcccttttaaaataggtctggctgcgcagttggcatccagttagattggcaagccatgtggcattactgtccccacatccacttgctttcttctggagtgaactggatattgtgagcaggtttctccccaccctatctttgcccccagagaagcccattgtgtggatgatcgggagatggaaatgagtctgggcccctccccaagcccagtgtgatctgggaggagccacttggcccctatgggcttctgcttcatccctgtcctggagcaatgcccagggccttggggtgctggaggcctcccagccctcatccagccccatccattcttctttgcaggccatcctgatcacctggacaaagcgatttaaagcgagcggagtggaaggagcagatgtggtcaaactgcttaacaaagccatcaaaaagcgaggggtaatttctcctgggccctctgcctcagccatgcaggggtgtggggagcagggctgcattctaaaacagaccagtgcccttcctggggggcagtagtgccaaagcctgaagacccaggcaggggagagttgagggctcacagtgtggaatgatgaggatggggatggtgcaaagcccagctctcggaggtgctgcctggagcacccaggcctggagcagggggtcacctcctgacaggagtgctgggctattcagggagtgggtgtcacggatgcagcctgctgtgcttagaacaagggcagaggagcccgccttatcggggacgtggacctcctgtggaggtttgcagaggaatgtagctccatgagtaaaatccccactacccaaagactcttaagccaggtaattaaggaaactgtgaggttttcatcatttaatcaccatgctctgatctagttaatttgagtaccagctgtaatgaaaccagtaccactcacaaaagcaggggttctgaaaacgggagcacttctgccaagcgctgttaaggtgtgtgatctctgctcccatgtgtgagtggacaatgacaccccgttatctgtccccaggactatgatgccaacatcgtagctgtggtgaatgacacagtgggcaccatgatgacctgtggctatgacgaccagcactgtgaagtcggcctgatcatcggtaatgcattcccctttgcccatccatttgttcggcccatctttccaggtggctctgcaccctccccgttgtgtggtcatagcttctgatcttgtcctgcccaggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtgagtccttgacttttgcttctaaccacatatgtgagttaggggacatttgatgaaagatttgggatgggagatgaaaagggcataaagccaagtgatcacaaacagaaaagcctgtcacattttttttttgaggcggagtcttgctctgtcacccaggctggagtgcagtggctcaatctcagctcattgcaacctccacctcctgggttcaagcgattctcctgccttagcctccaagtagctgggattacaggcatgcatcaccatgcccagctaatttttgtatttttagtagagacagagtttcaccatgttggccaggctggtctcaaactcctgacttcaagcgatctgcctgcctcagcctcccaaaatgctggggttacaggcatgagccacctagcgcggcctaaagcccatcaaatttgcattatttgttgctccttgtttggtgagatgcacagctgtagagtctgtagctgaaaagcacctttaaaataatcttctctttgtttaattacactatgattgtgtccttgtaaaacatcatgaaaacaaaaagcacagaggcattgatgcatcttggtgtggggctcacaatgaacccatctgatggggaatgcggccagagttgagcaggtactggtggtcaggggaggagatcaagaggtgaatgggagcccaggagctcagtagcccctgaaaaaaaaaaatcctcaaattatcccctgctgcatgaaaattaataaatatgaatggttcaaaaatgcttccccaacaaagcacaggaaagttagtgtaaatgtaaggtttaaaaaatatctctatgctgtagtcacgagtgttgctgttcatggtaagagaggccaacatggtatgtggggcatctaagggagatgagtgtccattcattcatcacatatttattgagcacttactatgtgctgagctctgtgctaggctctgaggatccaaaacagcaccttccctcccaagacttacaatctagatggggaggtagggcagacatgcaaatatctgttgtgcagaggagttggggtaagaagagtataagtcatgtagacgttagggagaatggagaagcaacctccattcttactatggcaatctccgtatctccaatgtcaagcataaatagacacaccagagttgataaagaacagaagtaagagtgatattattcaggttagagtgggtattgctttctctgagccacttatttcctgaagtgcctgctcacatttctctgtgatgctggcatgctgctagctctctctgatctacccagcctcccagcagccttatcccagagttggatactgtcaacctacagagagatgttcactgactctgtagacctaataacccttatcctgatgctagagggacaggaatttactagccatattgaaatgcatgacccaaaagatctcagtactgcagggtggacagttggcctttccacctgaattaatggattttcatcaatggcgagctccccaccagtggaggtggcagcagtgaataaactaggtttctcagtgagggaattcccaagttcttacacccagagttgagcatcaccattgcaggctgagactgtggtaccagcttggtgacaagggaccccagttccaaagctctgacagtcaaaggttttttaccatacccccccccaccccgcccaatccattgaccccactggcatgacatgaacttattactgtgcctatttgtatgtttcactgaatagccctgaatgtgcttgatggcagtgctgcctcaggcacctctggaggtattctgtgacacatggcatgtataccctgttgcatctctaaaattctcaaatctccacattcccaagcacatgtgaccccaaagggtttcagataagaggttatgtacctgtagttactatcagtcacttaatgagaagtctcttttcttagaagtgcaggtggggcatgccacttgtggtaactcgacaggtaatgcccaggcccttatccttggttcccagtttgggaaccctgcatggcttgggtgtaaacttggatctctctgctgtccattgatgtttgcctgaaattttccaaagagatgaactgtatcccaaggctaaactataaactgtgtttacagttggcttgcaataaatatttttgggatggatggatggatgggtggctgatgatggatgagagatgagtgggtggctaaatgggggtacagatgagaaagtgaaaggttggggcaaaatctcttttcttgaatatgtttctcagttgtattagtctgttttcacactgcctataaagacatacccgtaactgggcaatttacaaaagaaagaggtttaataaacttacagttccatgtagctggggaagcctcataatcatggcacaagtcatgtcttacatggatggcagcaggcaaagagaaattgtgcaggggaactcctctttataaaaccatcaggtcttgtgagacttattcaatatcacgagaattgcgtgggaaagacttgcttccacgttcagttatctcccactgggtccctcccactacaacatgggaattcaagaagagatttgggtggggacacagccaaaccatatcactagtttactgcatactgtaggccaggtctcattgagaacaattccaaggaaatgacaaattcccaagttgcatcacatattcctggaaataggctgtaggctaaagagtttttttgcctaagcaaatttttgctgtgcccccaggcttctatctgaatctttggatcttccctatgtcgtttttccatggaatgcctagttcttgaaagccattttaccctctttgtggcagggaaagacgtttgctccatttgactgatgggaaaattatggccctagaataggacagaggtgacccaagactcattgttgaggtgtggtctggtgtaggtttggggatttttgccctgtttgaaggtttgaggttttcagagtgagcttccagaatcttttctcattggtaatcagggaggatctagggaagtgatttttcatctctgagtacatgttagagttacatagcggtcttttaaaaaaaatactgatgtccaggcatcctctcactaatgattcagttggcctgggttgcccagtcctctgtattgtaaaagctccctgggcgattccaatttttaaccagggttttttttttgttgttgttgttttgttttttgagacagtcttgctctgtcacccaggctggagtgcaatggcgcaatctcagcttactgcaacctttgcctcccaggttctacgtgattctcctgcctcagcctaccaagtagctgggattacaggcgtctgctgccacgcccagctaattttgtatttttagtagagatggggtttcaccatgttagccaggctggtctcgaactcctgacctcaggtgatccagccaccttggcctctcaaagttctgggattacagacgtgagcccccgtgcccagccattaaccaggttttaaaatctcagtgtgttagatttgtgcaaaggctctcagtgcccaagtgggctctagactaccaacagctactcattccatttgctttgattggagttagcatttaactgagtacctactgtatacagtggacagggaggacattgtcataatagctatgtggctcctgccttcattggtagttactgcatttgggaggcagcagaggaacctgctttgagtgttcaggccccaccttgccccagagccagaaggtctgtttctaaaagggatcagtcttttggtttccttgtctcgcccttatattccaggcctttgatattcttgccacatgcttgtcttatactgtggagttagccccaccttttatatcatttttaattctccttcccttttgtttccttgaggtttttttttttttttctttgagacagggtatcactctgttgcccaggctggagtgcagtgatgtgatctcagctcactgcagccttaaactcccaggcttaggtgatcctcctgcctcagcctcctgagtagctgggaccacaggcagcagtaccatgcctggctaattttaaaatttttttatagagactgggtctccctatgttgcccagctggtctcgaactcctgggctcaggtgatcctcctgcctcaacctcccagagtgctggcattacaggtgtgagctactgcacccggcctgcttgggcttcttgctcttctgctcttgctctgtgttctgcctggaatctctgggatcttgaatcctttttccctgtgattccttatcacatccttcaaaatgcagagcccccaccccacacaacaacacagcaacagcagtgactgcaacagcaaacgctggtggttggtgttcaggagagctctttggcctggatggtggttgagtaactgtgcgccttcaagtcagcacccagatgccttttctttctgtggttctgctgctccatggaatctctcggcagctccggtcctggtttgcttggccatgggcctctgtctcttttctttccttgggcttctacctgaagcagacccagggtgctgagggctcctctttggtgtgcaggtccttgcccatgacttctcgtggttgatgatgctcccctcccccatctcagcccttcctgggcccaccagcaggcagattggttggaacgctgccacgccgcctctcactgcctgtctgtggtcgtaggtgtctgactgccgagacacctgggcattacctgttcagttatcacaaggaaaagggcccgggcgttacccgttcagttatcacaggtggcatgccctgagaggcagatcatgacttgctcgatttcattaatttcacttgagcagatgggaagcacgctgttggaacaggagccggtctccatgagccttggtttgaacagagagaagctcgtgagaggtgctatttgcttgttctgctgctctaacagggcctttagggactgggaaaggacagaccctggccgtgggcctctatctggaaaagggggtatcactatccatgtgtgtaataggccatgtagaaaagggagcagattgttctgggcgtctttagaaggcagagtgaaaagcagcgggcagagggtgccaggaggctgatgttagcgcatcctatggggaatgccctttctcttgtcacactgcccaacagggaaggctgcctagggaggagaacaggcagagaagctggggtagggtggtcctaggtggctgctagcatgatagtgacagctaacattgagtgacacggtccatgagacaggcaggaatgcacagtggttaggagtacaacttctggtgttagatctaactggattcaaaatgtggattgccacttgttagccctgtccatgggcaagttatataacctttctgtgcctctgtttcctcatccgtgaaatggggataatgctaatgtctccctcctagggttgtaatgaggatgaaaaaagttaatacaggtaaagtgctgggaaaagtgtcagacacataggaagggccacaggcactcattgttagccagatattgtagcactatctgacctatattaacccatatcctccatataaccttacaggaaagcagtcagtatctcattgcacaggtagggaggccagggtgagtagctcagtagtggctctgccaggcctccaccagtgctgagattcctgttcagggctacacagaggctgttcccacaggagcctggggtggcaccagacttagaagggcactgtcctgccagggatcctctgcctggctgcagccaggcggtcacgtctggttctgtcaggagcaggaacaatgaggactgtgtttttaaggaggctctgtgccctgtgctgatggttgagggccgggtgctcaggtctcggcagcatccttggcttctgggcggctctggttggaacagattgttttgctgtgtcacagccagctgtgggtgtgccagctgggctcccgcagaggagcggcgggctgctctgatgtgcgcccacctcttcaatctgccctgctcaggggttcctcctggcccctcgtcagccaggatgtgggggctgaatctggctcacatatggcatcgagccctggttcttgccagctcccggctgggccttcagcaatgcgtgttggcttctatctctacacctggctgcctctcccctgcagcattgggctcattctgtcattggtcggtgcttgaccggggctggagctgtgcggtgagctgattggctgtcagtatgcagagcccagccctggagtttagggtaacatcagtgggggaggagtgagttcctcaaagcaaattcttgatccttttggccggagaaggagaaaatcatgccagggaggtgcctaacaaatgtcctgacagcggccccagggggagtggctgcctttccctcggagaagctgtttaccctttctgagctgggaaatggggagaatacttcctggccacctcctatccacagggcttggggtctcccataggagtggaggtgaaagttctttgaaaagtatagcatacaagccaggtgctgtagcttgcatctgggagggtcgcttgggcccatgagttcgaaaccagcctaggcagcataaggagactccccctctacaaaaatttttaagaattagctgggcgtggtggtctagctactcaggaggctgaggtgggaggatggcttgagcccaggaggttgaggctgcagagagtcgagattgtgtcactgcgctctagcctgggcgacagtgagaccctgtctcaaaaaataaataaataagtaaatacatacatacgtacatacataaagataaaaaataaaaagtatagcatacagtttaggaggagattatcatattttgcacatttctatctggggccttcttgacatctgcaatctaaatccaaacgctccccctgccttcaggcagccttccctgcctgctcctgcccatggtgttctcctagtcacaggcatggggtctggatgactcctgccctctccacagtcggcttggcttccgatccctctccctctgctgttcagtcactcaagcacatggttttgcctgccagcgaggctgggggctggtgaggggtgagtcggggcttcccattccttttatgtctgtcccagccctcgtgtgtggggcgcagaggaaggctgacaagtgccggtgtgcctttctccacaggtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagtaggtaccatcccctcaaggctttcttggggtgttggggcagagaagagcaattggtcccttgttacttcttgagtccaagtttggtggcttttccttcaagagtgtcatggctttctgggtccgtgtcctctcactcttagttgacccattctgggccggactccctgaaggcacttgtggcggttcattaaagaatgacatagttagcctcaagtgcacaggtgattttcctgtctagctacaagagcagcctcctctcccacccccatcagcccatcacccccaccctccacacacactcagggtaagattagcgtccaggaagcagactattcgagcaaggagcaaggagctggtaaagcccggagcctgggtttttggaattccacctcccacttccagtctggagacctccagactgtgctgagggcactaagggcaccctagtaacctcaagatgttaattaggtgctccctgaaaaaagacttccttgaccaataggattgggaatatggcacatttatcttccagtttacaatattatggtaaaataaatacagactcacagtaaaaaagaataagaagtataaagtataaaaatacagatttatagtatcatcaacacattaaagaaaacccagtttgctttgacttgtcatttcccaaacttcttttgtgcttgaaaccaccccttccctgccacacacacattctttcagaggaaacctgttaacagccagaaatgtgccctgacgtgcaagtttgagaaacaccggttaacagatgagacaggacagttagaaggaaggacagagccagccagcaactaactgtagccccttggcatcacacaagaaacccgggattctctgtctccttgtgaagatttgcatcagctctctttgaggttagagaaggcagctgctggaagaggaaaggggtttatctggaccaactcttctgccaaatccatgtgctggagtttgttgtatgatcactctcctgagtttccagctgtcccttttcatgagtctcctggtcagtggctgggaaggaaggggagcgggagactcgtggattgtcttgaaaatcactggccaagtcaggaaatgcatgccttcctcttggcctgtttctggtattgactctttggttaccaagaaacacaaacccagctagctcaagaaagcatgtatattataataaaggctatctcaaaaaaaaaaaaactataaaaacatcctacaagagcagatgttagaggcattctctaaaatcaggagcgagacagtatcaccagtttctatttggcatcgtactggagtcttagccagtgggttttcgtttttgtttttgtttttaaagaaaagacgagagataaattaaaggtatgagaatcaaaaaagaagtgaaactgtcattatttgcaaatggtaaaagtctatatggaatacccccaaaatatctacagacaaatgaatagaatgacgggagaggttaaaaagatgtctggatggggtttcaccttgttggccaggctggtctcaaactcctgacctcaggtgaccctcccactttggcctcccaaagtgctgggattacaggtgtgagccactgtgcccagcccccatcctcttctatcatttttaaaatctcttctcccatcataaaattaatttctctcatattttttggtcaggtagaattgggaaagtcccacactctcctattctcgtattaccttaacatcccaagcttcctttccttttttggtctttatgaatatatttatatggacagaattaagataaacaaaattgatttccccattctctcacttccccatcttgtcttcctagaccccacagagttaaaacttgggactcccccgaccctcccagaacacttgtatattgtttgtttgaggttcgtgccgcagtaacagacacagtatttgattgcacatacagatgtttgctgggtatattcactgtacattttatttaatctggttttttgtttgggggttatttggggcgaggttggttttgtttttaaatattaaaaaaaatctgtcaaaaaaagatgtctggagataagatacagaagtcaactgtatttctatcagcaataataaaaatatgtacatattttaaaacacatttttaagaataattttagatttacaggaaagctgcaaagatagagtgtatgtatatgtgtttgtgtgtatgtgtgagtgtatatgtatgcctgtatgtatacatatatattttaaaggcaccatttgcagcaataacaaaactataaagtacttcagaatgaatccaacaaaagatacacaaaacacgtgtacagaaaattacaatttcactgagagacatcaaggaaggatgtataagcatccaggggcaactcacagaccccacgagtgggaggttctcctgagcctcatgagccctgggtggtggcagccatttcgccacctgttcagaggccacatagtcttgcctctccacttctcttcatggtcctggcttggcatagtgcaacctggtacagtttttcctatcactacctggcatttcttatggaggagaacccttcctgggctcttctcaggcatttgacagtcttcatcccataccatcccataccatcccacacatggtaagtggggctgtccctttccagcacctttgagcctcagtgctttgcactgcctcatgtggtcctcagtgcatcagtattggcttctaacttcacaggaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtgagtctgccctttgctatcattggcactctgtacccattgtgggtagggaccttctccagagatcagacttttgtacccggtaaacgtttttcggcagacaagacaatggtggtcgggggctgtggctcatgcctgtaatcttagcactttgagaggccgaggcaggaggaaggagtttgagaacagcctgggcaacatagtaagacctcatctttacgaaaaattgaaaataaataaatagataaataacatgcttagttctgggcataaggtcagcgtcgcccccttgggaagtatcgcccttagtcgattcttgctggtattgcttctgcactctgtcgttacctcgccctgtcaaaagtcgagatggagatttctgtagctgtcggctcctctgggtggaatgtgtctgtctctcgtccgcatttcatcaggaggaccttgggtcataggtgtggtacccacattcttgtttcagaagctcctgttaaaaccccccaaaccctcagactttacttttttaaatgggcagcttgtctgtgcttggcctctgagagctggagctgcaggagctgtaagttgtccccattggcaaggaggtgctttgttccccacacagccttctggtctgtcagtggccccagccagtcctcatgccatctcaccttagttttagaagccatgttgtcctgtgagaacgtggcttatactttttttaaaaggctaaagggaaattctaagtcattatttaataagttttaatgctagcctgtgacatgattgttttgcacaggacctcagagttgtttcccactgtacatataaatacaatgtgcatgtgaagcacccatgtcagtactgcaccttcacacccagttctgttgatggctcaaagaatgtcgacttcaattgaaatagttctggcctggcatggcagctcacacttgtaatcccagcactttgggaggctgaggcaggtggattgcttgagcccaggagttcgagaccagcctgggcaatgtggctctacaaaaaatcatacacagctgggtgtggtggtgtgcctataatcccagttacttgggaggctgaggtgggaggatcacttgagcatgggggtgcagaggttgcagtgacctgatgtgcctctacactccagcctgggggacagaatgagctcctgtctcaaaaaaagaaagagagagaaatagttttgtgttgctgaggggatagggtttgagccaaggacgtaattgtatttttaaaatatttttaaagtatttgcaaaaatcttgataatgaaacttttattagccatttctttcttttttctttgtaatttcttggctaattttttggacaagaaagcctagggatttgcagcatcacattagaatttttttagattgtggtaaaatacacataacatgaagtatatcatcttaacctttttttttttttttttttgaaggcagggtcttgccctgttgcccaggctggagtggagcggagtggtgtgctctcagctcactgcaacctctgcctcccaggttccagcaattctcctgcctcagcctcccgagtagctggaattacaggcatctgccaccatacccagctaatttttgtatttttagtagagacggggtttcaccatgttggccagactggtcttgaactcctgacctcaggtgatccacctgccttggcctcccaaagtactgggattacaggcatgagccacctcgcacttggccccatctgacttttgaacaccgtgcttttgaccactgtgctgtattatcttcctgtcatggtggagggcaaaatctttttagacctggaattttttgtatgtgatactcatgtaataatgagagtcttctctttttatgtgtgattatgaacgatttcatttttcctttttacctctctgcatttgctaacttttctacagtggatgtatatgatttgtgtaatgaaaaaagcaggtgcagaaaatggaattaggctgggcacagtggcccatgcctgtaatcccagcacttgggaagctgaggcgggtggatagcttgaacctagaagtttgagaccagcctgggcaacatggcgaaaccctgtctctactaaaaatacaaaaaagttagccgggcgtggccccagctactcgggaggctaaggtgggaggatcacctgaacctgggaggttgaggcagcagtgagctgtgattgtgccattgcactccagcctgggtgacagagcaagaccctgtctcaaaaaaaaggaaaagaaaaaagagttaaagagtggagaaagaaagggtggccggaggtccccaataaatgctcagtccagctgttgtggaatgtcccccctgcccccataaggtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccggtgagggcctgctgggggctgacatgcctgtcctgctcctgccaggaactgagccgcagtgggggaggttggattcgccagtggatgccttcacactggtgatgcacgattttgccagagctagaaactccctcacatctctgttttccatttttattaactgatttgtcatgtgtgtgactcagggcagtttaattttcctggtcagacctcccaggcaagtgctatctctaaaaccacagccctgctcagaacagtgctcttagctgggcaaggtgacacacgcctgtcatccagctacttaagaggctgaggtgggaggactgcttgagcccaggagttcaagaccagtctgggcaacatagcaagaccctgtctcaaaaaaaattaaatgaataaaaaagaagtgttcttaaaagctgggcaaatcccacagcactgattaggttttcccaaagccaaggaaagccagcagaaggataaacactcagtgtacccttcttaaatcttgatagagtatgcatgaggcattcagggcctggggagtttcgcattcaggcaaattgtagaacaaaatccaaccctttatgctaaccttggtagttttcactggagctgatcattatggggaatctgaagagcttttcaggtgggtccttggagtaacgaatgtttgtgacaggaatgtgtcctatgtgtaagttacctaataccacattataagccaccctcacacttagtggcttaaaacaaccacgctttattattgttcatgcatctgtgggtcagttggacagttctgctcatcagggccaggattggctgacctctgccggcctcattcctgcatctgcagtcagctgttgagtcagctgggaggcagatctcagacgcccttccccacatgtccagcagttggctgtcagctggggtgcaggggcccctggccctgtgtctcatccttcagtgggccacctggctgttcaagtggtggcagcaagggctgcgagggagaggggaagacttcaaagcctcctggaagcccaggctggggataggttcagctttgcctctgccacactctgttggcctgaacaatcctagggctgggctagatcccaggggaggagaaattgactccatgtttcagtgggaggaactgcagtcatgttgcaaagaaggattttgcacatgcagggaagggaatgatgcagctgtttttgcaaataccccacaccttgacataaattattattttttgtaggagattttcattgttgcagccctggtgaagtctgtgtattgtgacaggtggtttactcacatgctctcctcccagtgtggctccaagtctgtggtggtcagagatgtggtgcccactcttcctctgagtctgtgctgtgtcctaaagggaggagttgcagcttctcctctatgtttgctatggggttctccccttgaaagtctggagtcttggggttactggctgccaagaggcacttagctgtttttgacattctttacgcttttgactgcaacagagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagaggtgagattacaaaaccatagtgcatgtgcactgcacacacggccagtggcaccggcagtcacgtgatgaccaaaatccgccacggggtgcccacatggatttgtgtccttgtggcccagaagcaccagatgctttttgccatgcctggcttgtgacactctggtggctgagaagattctggaaaaggaggctcactctgcatgtgtgtggggtgtgttttcctacgtgtgtgtgtgtatacacactttggtccatgtgcactgataaaattaaaaccacagagagcacgggcgatcctttcttttcccctgcagctgtttgatcacattgtctcctgcatctctgacttcttggactacatggggatcaaaggccccaggatgcctctgggcttcacgttctcatttccctgccagcagacgagtctggacgcggtgagtctctgttcttagggctcagtgatcgggcagcactgagtcccctgtggcctgggtgggctggcccttgaggccttctccagcctcagtgtcattcctagatgacagtcacagtcacagtgggttgagccaggctttatttcacagcctgcagggcatactgagactcttctctcttcttttctctttgaaagcgtcaccttttctgggaaaccttctggtcctccaagcaaaaaaagaacctcatcctcttctgtgccccctgttcatttgattgttgccttgcttataacacttcttacacagttagttcttagtgtcttttgtttctgctagtggtagactccgtgagcaaggacctgtatccctgcacgccctagcacagtgtccaatcagaggagataataaatgtttgttcaatatatgagatgaatcagggtccaggatcagagcttgagcacctgctgactactgattggctgggctcagagctgaaggttacagctcctgtcctttggaaggccacagtctagtgggggagccgagtccctaacaccagcagctccagctccatgctgtcagggctggggagtggattctgggcagaaggaaccaatggtgcagagtcacggaggcaagacccagcctgtcacgctggaagagctgtaggtagctctgggtgtcacaggtggagacgtgaccaggcaggagttctggaggtgggtcttaggccagggtttaaggcttaatgagcagccctaggagagttaggtagggtcacctacctctgtaaaccagttaatccagttacatcgctgacttgggacttttttcttctgaaacccttttagagctcaggagttagatctgtttgtttgtttttaaagcatttcacttataccttcaccttggattcatcatagtcaacacacacccagtgtactttcttccccaggaagtgttttaacttcaatccagtgaaagctaaaatgtactttaggtagacacagtattactaaactcttaggatccttcagttatagtgtcagtagactcttctgtacagctggttatgccagtggcagcaccaggcttggaatcgggtgatctgggctcttgtccagtattgagtgccgtctttgccgtctgctgagtgaacttagacattgctatttacctaatgtgcctcatgctccatctgtgaagtgggattatttcaaacccctatgaggatggtgaggagggtctattcatattttattggtttgtcctcagatgtttgaactccgtctccgatgttgtaagccctcagcagttgttgactcaggagggagggttggaattttgtgttctccccttccaggttaattacacaggactctcctggtgctttttatgttgtagggaatcttgatcacgtggacaaagggttttaaggcaacagactgcgtgggccacgatgtagtcaccttactaagggatgcgataaaaaggagagaggtaactattaaaagaatgttttttaaaatctttactgttttaggggcttctaaaaagtgtatttgcctgttgtaaagaattcaggccaggcgtggtggctcacgcctgtaatcccagcactttgggaggccgaggcgggtggatcatgaggtcaggagttctagaccagcccgggcaatatggtgaaaccctgtctctactaaagttacacaaattagccaggcgtggtggtgcgcacctgtagtcccagctactcgggagactgaggcagaagaatcgcttcaacccaggaggaggttgcagtgagctgagatcacgccactgcactacagcctgggcgacagagcaagactccatctctaaataaataaataaataaataaataatacataaaaaagaattctaacaatacagaagtatgtgacctggccaagaaaagctccctatttcctgactccactgcccgcaataaaataagggctcataggtttgtgttgttaaaagattattattattttttttttagaaaggcaaatcatgactctcatacaaattgaaaaagagagaagcagcccctgacaggtgggcacagcctggcactctcagttaggccttggtgttctcctgtggaacacaaacaatttcacagagtccacaaacaattgcagagcagaaacatcagacacagccactccgtccgggaccatgatggatttagacaagaataagaccagtctgtaaccatagaattgcccctggttcctgacaatatccaatccagagcaaagccccacttctttaaaccttcccccaaaccacaacacagacacagatccaaattaaacttttttaaaaaaaatttttagaattttaaagtttccttttttgagacagggtcttactctgtcacccaggctggagtgcagtggagcaatcttggctcactgcaacctctgcctcccaggctcaagcgatcctcccgcttcagcctccctagtagctgggattacaggtgggcatctacatctggctaatttttgtgtttttggtaaagatggtgttttgccatgctgctcaggctggtctccaactcctgggctcaagcaatctgctcgccttggcctccaaagtgttggggtttttaaatagaggtggggtcttgctatgttacccatgctggtcttgaactcctgggctccagtgatcctcctgcctcaccctcccaaagtgttaggattccaagcatgggccaccacaccaagccactttccaagatgcccccggggtgtgttctccagtgttgcaatgagtcagtaaagcccaactttgttagattacaggtgtgtttctcgtggtctttggctggaggacattgaaaaaatataaaatgaaaaattcccaagatttaatttaactcattaattaatgagggagtcagtaagagactgttttaaattttttttttgactttttttcaaatcccattacactgagcaaagtaagaactttaaaaaacaaaacaaaacaaaacagaacacttcaaataacagtctaaagagcagacagatacctgggcactaggctgtcagggaagctgaaatgagtgtctgaaagagggctgatttgtctgctgtcttttgcagttaaatagaaaaaaaacaaaaagggctgagttgcatctggaagggtatgctacacaacttacaatatttcattgaaaatatagctgcgggttgggtgcagtgactcacacctgtagccaaggcaggaggaactttgggaggccaaggcaggaggaacgcttgagcccaggagttggagaccagcctgggtaacgtagtaagaccccgtctctataagaaattaaaaaataaaaaattagccgtcatagtggtgcacaacctgtggtcccacctactgaggaggctgaggtgggcggattacttgagcttaggaggttgagtctgcagtgagccgtggttgcggtagtacactccagcctgggtgacagagcaagactctgtctcttaaataagaaaggatacctgctgatctatttttgcctgcttcacaactattagtgttaattcttctagcttgctttccatgcatatgccaacacacacacacacactcacttaaaaataggaattataccatatatacaacatgacaaattgcttttttgatttaatatgaaacaggtatccttcctcatcattgcatttagatcaacctcattctttttcctggctgcgtaggattccagcatgtgtctgaattgccttttacatagcccatttgatcttcacttggattgtttcctctttctgactattgcatgtcatgcagtaaatatccttgtatgtgtgcgtttgtgcacctgcagactatttctcaaggacagattctgagcagtgagtttaatattttccattttgccctctgaaaggccataatgctttaaactccaaagggaagaagctatttgaccattgccccttgtctctcctattctatgattcctctaatagtatcatcatctgtaaaatgggtagaatactttcccttccttagatctcatgtttcagatatatccttaatagcaggggtttagtctgtgaaggaacattcattacctttttgtaggctggtaagaaaaccatcttagatgatgaccagtggctctctgactgcagtgcaacagacagaaccggcagcattcaagccaggcatagtgatcctattcctaaagctgtgtccctttctttgcaaaggaatttgacctggacgtggtggctgtggtcaacgacacagtgggcaccatgatgacctgtgcttatgaggagcccacctgtgaggttggactcattgttggtgagtgtcctggaaggtctctttccctgcagaagggaaggctggggtttccccgttttgtggggccttggcccagcagcttggtcctctgtatggggtagtcttatctgtcagtatcatttcttgaccagctccagagttcagggctggacgaaggcagcagagtctctggcggggggaggtgggggggcctttcttaagacacccataatgctacacattgcttatgatcagactgtcaagaactgaactcttcaggaatgaggacccaaaaggctcacttggcttgagtggagacaggtacctggagcgggcctggcaaacatggcagctctatgggccttgtatggaggggctctggtcaggtattgcagggggatggggtggggagggagtctgcggctggaaaggaagtagagagcacctcccatgctgaccacacttagagcatggaaaggggcaggatggtcttgggcaccattttgcctttagcagccactgtgtgcgcatggtcccagccactgaagggggttgcagaggggttgtctctgcagctcgttgccttgtaatccaaaacacattaggggtctgggcctcgagcacataattcctgaagcatattgatttgggctatgaggaaaccatttgtcctgctggccctgctcctcgcgtcaggggatgctgggaaagaccccagggagtttcttagccaacatctgcggactctgcctggtgagtgagcagtggcacccctgctactggatcagttgctgagtgtctagagcttgggaagaggccccagcaggctgccttccaggtgccaggaagaacttttcattcattgttaagccacttttcgcttctgttgaaattttaaaaaacctagggagcagctgctggtgaaaaggttgtttggggcctggctttctccacccagcccctccctttctttccatgaatgggcttgggtatgaaatgcaaagctagagtgacacagcagctctcctcctcctgcaggccccaccttccctcctgggaggtcaggcccgcccgtttcctggcaccaggctccagctacatttcatagctacttcatagctactttttctttcctccatcaattgatctctttgctcaggactcccataggcaagatgtatggtttccatgttttggctttctttgcatctcccactcccatcatcttccgtttctggagctcctcttctctcagttttaaccttgggtgaaaagggggctgagaaaacaaagaacaaaaatcatccaactgtacagtctttgaactctacttaagtttcttcaaaggggatgaaaactaccaaagcccttttggtctggccagggggtgtgtcttgtgccctcccgatgaaagttcacctacatcccaccctggatgggtggatggtgctcctgggcgcatcattagcatcatcctgggagcttgttagagatgcaggctctcaggtcctggccctagcctcttgaatctggatctgcttcttagggtccccaggtgatccaggtgcatattaaagtatgtgtgtgaagcactcttcctgggttagttgattggtttttaaatgtccagtctattcagtgaggcaagttcagtgaccacaagcttggatatcatggcaattaaaattgctgtgaaagttgcaggatgcttgccttcagtttcttagctcctcatgggctggaacagcaaacagtcggtggtccttctattttgagtgactctgctctagggagttcaggaatggaagtcagagattcctgagcccctggcaagcatatgtcaggttgcatgtgtgcggtgtgtgggtccacccagagaaaggtgcctttttcacagaagaatcctctgatcttcaaaggtctgatacaaaaatgatgaaaaaccattgcttttgaaagccccccttgaaatgctgaagacactgtcctgccctgaactgtgggcttcatcccaaggtatgtaggaaagcttattgagcaggcatagtccacgaccaaccatccttgtcgagaaaagataagtggggctgggcgtggtgcccacgcctgtaatcccagcactttgtgaggctgaggcgagagggtagctcgagcccaggaatttgagatgaacctaggcaacatggcaaaaccctatctctactaaaaattttaaaaaattagccaggcatgatggtggtgcctgtagtccagccacttggaaggctgaggtgggaaaatcacttgagccctggaggcggaggttgcagtgagccaagattgcgccgctgcactccagcctgggtgacagagccagaccctgtcttgaagaaaagaaaaagaaaataagtgaatatctatggtatgatagaagataatcccctaatattttatacacatatatataggcatgtatatattgtatattcatgtgtgcatgatgttgtgtgtgtacgtatatatttcttcttctggtctgaatgttgcctaaacctctaccattgatgctccatctctttgctataaagccatcttctattaaaataaacataaccctgcctggacgggtgaacacattggctcttggttgaaagtcagctaagcaggtgccctctgggtgatgtggctcagactctccatttacatttcaaatttttccatttcaaaattgggaaagaaaaactattactttgttcatcacaaaaaacgtgccccctgcctgtggaacctcaggccccagaccccaggcccagttgcaagacccccaaatgcaaggccaccgctcctcattgccccctcgtgtgttccagggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtaaccccgcctggtggagaggacactcacagtcagggtgggggcagcacttggctgcattctgccacttgcagtggaagaagtttctaggaggagaggtctgaacagaggtttcaagactggaccccctggctcactcctgacctttgtcttttggacagcagagaaccagggaggacagacccccaacatggtacaagatggcccagggttgatgcctgtctaggggctgcctgtgactgttttttagcctggaggattctggccttccggtccccttgctgtgttcctttcccatcagaataacaagggggtggggtgagggtggctgggcggcaggttggtgtgaagcagaggccctgtcgcaatcgtcctttcctccgtgagcctcctgcaccacctagtggccttgtggagctttgcagctcaggtctcaggtaccatgtctgaaatggcagtgtctgccctttgtctcaagcccccaggaatcaggccatcctctgccacggccaggatgagttggtccaagttgtctccctaggagcagaaagaagggctggagcagcacccagcatgagtcactccctagccccctcaaggtttttgccttttctaaataccacccatgctgttatttacttagtgcttttcttcgaatcagcttacagttttttgtttttctttttgtttgaggtggagttttgctcttgttgcccaggctggagtgcaatggcgtgatctcggctcaccacaacctccacctcccgggttcaagcagttctcctgcctcagcctccccagtagctgggattacaggcatacacaaccatgcccagctaattttgtatttttagtagagacggggtttctccatgttggtcaggctggtcttgaactcccgacctcaggtgatccgcctgtctaggtctcctaaagtgctgggattacaggtgtgagccaccgcaaccagcccttatagtctttttcttttcttttcttttcttttttttttgagacagagtctcaccctgttgtccaggctagagtgcagtggtgcgagctcagctcactgccacctcctgggttcaagtgattctcctgcctcagcctcccaggtagctgggattacaggtgcacggcaccacgcccagctagtttttgtatttttggtagagaccaggtttcaccatgttggtcagactggtctcgaactcctgacctcaggtgattggcccgcctcagcctcccaaagtgctgggattataggcgtgagccaccgtgcccagtggcctttaaggtctttactgacatttaatgaaggaggaaaaagaggaagaaccaatagtaccataaagagatggtaactaaaaaatgagtatagtgaagaaccgtgctattcaagtctagctgatgctgtcgcctaccaaatgacctgaactaagaccccctttgggctgagtgcagtctatcatcaaagtaatcccagcactttgggaggccaaggtgggaggattgcttgagctcaggaggttgagaccaccctgggcaacatagggttgagaccctgtctctactaaaaattaataacaataataacaacaataatagtaagacccccttggttaaaaagcggggggatcagcaagtgttggaaggggttaaggacatgtcagcaccaaactggggtggtctttgtggtggaatgagaaggactgggtgggacttcgtagtggtggcccacccctctgtgattccattctgtttcatgttcttccatggaccacatgaaataggaggaatcctggagttccaaattccaggggactcttctcagctttgggacactgggcttgggcatgtgccatggaaatgaatcaatcctttgttatttcttgagatccttgagcatggagagggcaggaaatttgaagtcccaagaacaggttgacctccagtgtgttgtggtcactgaattctccctcctgtgtggcctcatcactctgctgtgggcttgaccagtactctgggtatttgcaaaacctttagaaaaatctagaaactttccttttttttgtcttcttgttcctttaagacttagcccagtcatttgcttattctgcagatagtttttgggcactttcctgagggcccagtgctatgctatgctgtgctgtgccctggggactcagagctgaaaaagacacacatgccctgtcctcttggggctgtcactacagcagtggtggtgggaggcagtgagctcaggtgtgttgtgaaggaggagaatggtgaggtgtgtgggaacctgaaacaggcaggtagaacccaggatcaggaggaggacaggctctcggggaagtgaccttggggctgagagctatcaggcagctgaggagggagaccagtctagcaggtagacatgaatgctggtggttttgtttctgatgtgagagagtggaggactccctggtccttcctggtcctcccactctgcctctgcggcagagcacagggctgggcacatggctgttgatgatgcgcttgaggggcagtaggagacgcggagtgaccgtgagaccgaggggtgacagttctcctggccacttcccatagacaccccaggcccctcctcctgtctcaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagaggtgagtgggcagtgtcttccctgccagcgcccacccttcagaggtcgcctggctggtggattgtgatgggggtggtagggaccctaggggacattttggccatttttgaggattttttttcctctggaatagcagaccctgggcatttgcatagtgaaatcttataattttattataaattacttttcttggcctggtgtggtggctcatgcctgtaatcccagcactttgggaggccgaggcaggcggatcatgaggtcaggagatttgagaccatcctggctaacatggtgaaacccgatctctactaaaaatacaaaaaattagctgggtgtggtggcatatgcctgtaatcccagctacttgggaggctgaggcaggagactcacttgaacccaggaggtggaggttgcagtgagctgagatcgcgccactgcactccagcctggcctggcaacagagcgagactgcatctcaataaataagtaaattacttactttccttttatccatcctttatgttggggcattatattgatttatttgaaattatgtgtgtaagagggccatatggattccatttcagatggtaaagatgcactacacatacttgtattgggggtgcatagggcccacctggatttatctgaaaggcagcctggggttcagtgccaggccacccaggagctgatgcccctcagcaagttgttccaccttctttctacttttctcctgtccagggtacatttcttcctggcctttgctgtcttctaaggcacgctgtgtgagaaggaggaaaaaagggtcagaaaaaacaaaagcaattgtgcaaatactgtgttcttcttagaatggtcataataacctaacgtaggctctgtgtaggctgggcacggtggctcatgcctgtaatctcaacactttaggaggccaaagcaggtgaatcacttgagttcaggtgttcgagaccagcctggttaacatggcaagaccccatttctacaaaaagtgcaaaaactagccgggcgtggtggcacattcctgtggtcccagctatttgggaggctgaggtgggaggatggcttgagcccggtggcggaggttgcaatgagctgaggttgcaccactgcactccatcctgggcgacagagacagactctgtctcaaaaaaaaaaaaaaaagagaaagaaaagaaaaaaaatattaaaccttaaacaaaaaaaaacctaacaagcctatacactgctcttacccaggcaaaatggtttttaagtatacagttcggtgacattaagtacattcacatagtcgcacagctatcaccaccatccatttccggaactcttttcatcttctcagctgaaactctgtacgcagcaaacactaactccacattcctccctccccccaccccagcaaccaccattctactctctgtctctatggatttgacaactctggatacttcatataaatagaatcatacagcatttgtcctttgtgactggcttaattcacttagcataatgtcttaaggttcatccgtattgtggcatgtgttagaatttccttatttttttatttttattttttgagacggagtttcactcttgttggccaggctggggtgcaatggtgcaaacttggctcgccataacctctgcctcctgggttcaagcgattctcctgcctcagcctcctgagtagctgggattacaggcgtgcgtcaccatgcacgcccggctaattttgtatttttagtagagatggggtttccccatgttgatcagggtggtctcaaactcccgacctcaggtaatctgcccaccttggcctcccagagtgctgggattacaggcatgagccaccacgcccggccataatttccttatttttaaggctgagtgatattccattgcatgcacacactgcattttgtttattcattcatccatccatggacacttggcttgcttccaccttttggatattgtgacaaatgctgctgtgaacacgggtgaccagtatctcctttcagtttgtgtgtgtgtgtgtacgcaccccaagtggacttgcgggatcatatggtaattccctgttcagttgtttgtggaaccaccatgttgttttccacagtggctgtaacattttacattcccaccagcagcccgtgaaagttctagtttctccacatcctcgccaacacttgttattttctgagttgagaatagccatcctaatgggtatgaagtggtatggaaagtcttttcaagcataatagcaaagaaagaaatcataaagaaaaatggccaaatatagctacatagtgtctgtaagtaaaaaaaaaaagtaatcaaacttaaaaggcaacggtaaactgaggaagacatttgtactgtgtatgacaagacgcctagcagggcatggtgggctttggcaggtctggtctacacctgctcttctccaccggctgtgtgctttgcaatactcaatttctcccagcctcagttgccttatctttaaaatgggaataatcatacattcattggttgtttgaggagtaagtaaggtaatgtatgtaaaatatatgttacatggtaagtcctccaagaagcctggctggtcttcattgtaccatcccagttatcgtctctttcaatttaatataaataagacaaatatatcaggagaaaagtcttgagacgtaagaagtagtttatatggccaaaaaacaaatggaaaaaaaagagatcatcctcactaatagagaataatataaattgaactacagtcttgtgatgccttcttataaaactgtcaaaagttgtaaaaaaatgctcttttccagtgaggataagtgtggccaaatactctgctgaagagtaaatggatacaattttctgtaaggcatctggcaatgtgtagcaaaagctcgttgacccagaaatttatcctaaggaaaaacatcagaattgcacacaaagatttataaacaaaccttatcaaaatgtttctttataatagcagaaaattgcaattaacttgaatttctccaagctggctaaagaaatcatggtgcatccctagagggaatactgcagcagctgtttccaatcctgttctcagataaggctgtgggaaattgctcaatgcatgaaacaggaaagagaaagaaaatcacatatcaaggataatcccattttgcatatcatgagaagcataccagctaggaaaaataaactggaaggaaatatattaaaatgttaatagcattttcctagatgttgagatagtgaatggtttagattttccaatttttattttgctagatttgccaaattctccacagtttaacatgtaacacttgcccttgactctgtctgtggatgagtacagtgattgggggcggggggcgtcctttggacgtggtctccaggctgctcttgtgggtcctgcttcatccagccctctggctcttgtcccccacagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacagtgagtgggccttccagttgggatgcgcagagcttgctgggatccctttgggttagggggtatcagggtgtggtttacgctggggaaatgccctgcgggagcccagccaggctgaaggctgtgcgttcaggagctggggattgtctaggacaaggtaatgaacagtttgtagggtttgactgggatccttagggagacagagaagtggcttcacttggccagctcacaccagtggcatgatgtgaccctcaccccactcctcctggtcccccttaggtgggggctaggcagtgggagaggaggtgagggtgggcgtgggctcactcataagcctggtgagctgtagccaggccagaggctctgttgggtaagtggggagaggatattaagaaaggggaggagctgggtgcagtggttcacacctgtaatccagcactttgggaggcctaggtgggaggactgcttcagtccaggagtttgagaccagcctaggcaacatagtgagaccttgtctgtacaaaaaaattttgaaaattagccagggatggtggtgaatgcctgtagtcccagctactcgggaggctgagggaagaggattgcttgagcctgggaggtggaggttgcagtgagcccagatcacgccactgtactccagcctgggcaacagagtgagaccctatttcaaaaaataaaataggaaaggaggatagccactctcttgttcatctgctgaatcagtttgctaagacttggaagggcgggagcggtttgggccctgggcttcatggcagggaggggtagggagtggcctccctctggtcaggcatctgaccccccatgccagagaaggacatgtgattgcacttgctgtgtgattgtgatccaccgcatgtctcaccttatgaatagggtgaccatattatttatttattgtctacactagggtactcttgccagtcaagagtgctaataattattactctgggactgtaggcaaactaggaccatcccagataaatgaggccatagtgtcaccctacttataagcaacctcacccgactcagtgtagacattacctgcttacctcatggccgtggcttggggtggaaccatctgtcttgctccatcctcacctctgtctctcccccttaatagctgtccttgccatcagctgaggcagcacacaggagtggtttagagctaggctttggagccacatactcttggatttaaccctggcaccgtcacttagaatctgtgtgcaattgcttaatccctgcaaaatctcatcttcctcatgaggtggcagccactggcaggactagaaattagagctgtaaaatatggggcacctagtaggtcctcaaactccttggctcaagtgatcctcccaccttggcctcccaaagtgctggcatgagccaccgcactccgcccacctaataggtccccaaccaaggacagtgactacttttgagagcccctcaccacaagcatcttcagcctggccctgcccttcattttgagcccaacttacaagcatgtagattcagcctttgttcagatactatcttcactggaaggcattcctgtctttgggggccaggctgttgatggtggggcgctgggggtctcagggttgcagctggagatgggtgatattcattcctgcatagcctcctgaaccgatccagtgcttggctggcttgcacctgccttaatgatccatgtcagcccctaacatcctccttggttttgaggtccccctggagcctcaagctccgatgtgggtgtgtgtgttattcatgtcctagccttcataagccatacagagcagttgtgtttggattcgcagttgggcctccctgctgaaaactgtgacaatgggattgaccgtgggcccactttcctcccagccattctcaactggccacagctgcttctaagcagcctgcctcccaaccatgttcaccctccttgttgttgggttcagagtctctttgacttccgatgcttatgtcctgataaacccatcacaaagtcgaagaatcctaagtcgaatcatcaccagtcagggggctgtctgtgctttggtgttttcgggtaggcccagcgtctctcatcttcctccaactaccttctgttttctcgtcctttttagcttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattc

SEQ ID NO: 178 - DNA, 12404 bp, Homo sapiens; identical to SEQ ID NO: 104

SEQ ID NO: 179 - DNA, 5973 bp, Homo sapiens; identical to SEQ ID NO: 115

SEQ ID NO: 180 - DNA, 4395 bp, Homo sapiens
tatctgcctgggacgccgcgaggcagaagtaggcgggcccattgacttagtgtcaaggcggaggccgcgcttcatgccagcggtcacggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatggtgagtatctcgaatgcaaaattggggtggtaaggagcttagagatcatttgctcgcttttgggcggggaggggactgaattccagagagtttatatatgtccaagatcacacagctggtgagtggcgcagtcgggtgggtgggggagaaggactaggagtaaaatgtccttctttagcacgtccgtgggagtctccaaagaagtgtggagaaaacttggcgtcatattttctcatgatttggaatgaaaccagctaggcttgagttcctgcagcaccatgaagcgaccggagaagttatttcgccttttggagctttattttttcatctgccatttgggaccattagtaacccaggtcataggggtgtagtgaagattgagatcgtagtgatttgcatgttgcctggcagtagtaagtgctcaacgaaagctatttttactatacagctgtttaaccatgagcagaccacgcagctgtctcaaactaaacatgtccaaaactgaactcttaacagcttcttacccaaatttacttgccttgcagcgttaccatttcagtaaacgccaactttatccaccgttacctcccagaaacctgagacactttgcccttttcttacacacatccacatatcctaaaacaccaagttacaaaattctgtagagtttacttgtaaaacccatgctctccattttcatcgccactcgctctgaaaagacaattctggcagagggtaaaggaagggaacttaagagaatagggcaggaggaagcagacaccaaatggagatggtgttaagagacaagctaaggagaagcagtgagatgaaacagggctcctatgggagaagagcagtgtagcccatctagacagctctcctggactttggagttgattgttcactcactgttaactccttagtcaccatgcctatgagttacttctgaaattctcacttcttgataggcagtcacttcttctacacccccaacccccatcctatattttcaccaagatttgggtgtcttaagcctcactgtctcatttcttggatggtgtagtaagttagagaagacagagagggccaggcacagtggctcacgcctgtagtcccagctacttgggaagctgaaataggaggattgcttgagctggggaggtcgaggcttcagtgagctgtgaacgtgccactatactccagtctgggagacaaagcaaaccctgtctcaaaaaaaggggtggcaggggagcgagagggattaatgggaggatggcaaaagggatagggatttctataaaattctctgtcaagccatttgtaaagggagagttttactctccctccctgttttggtagagactgataatctcaaatacagtgggttttgtgtgtgtgtgtgtttttatgacctgaactttcagctctggatagaaaatagaggccttacaagaaatgttctaggcttttctttttatcaatatgtaaataggcataaagtgttaaaaactgggaagataaagcacatattgctgacaaatacttgctttttacagacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttatatagctgagtttggttttattctaacaaattacctggtggtgtgattgtgaggtgattaacagttctcacatagtttactgttaggtcacacacagacttccgatcataatccatactgcctttttgagcctaaaatcagcctactaccacaattaccaaatattctgaaaatttctagtatggtgaagatggagagatcttggtgtgaaggttaattttatatgtcatcttgattatgctaggagatgcccagatttctgggtttgtccatgagggtgtttccagaagagattagcatttgaatcagtagactgaataaaaaagagccacccactccactgcgggtgggccaaccccttgagggcctagctggaataaaaaggcagaggaagggcaaattctgtcttctctctgcttgaacagggacatccatgttctatccttggacattggttctcctgattctctggctttcagacatggaccagggcccctggttctcagacctttgggtttggactggaactacaccattggctttcctgggcttactgtctgcggaaagcagattgtgggacttctcagcctccataatcacaagagccaatccctcataataaatttatttctatata

SEQ ID NO: 181 - DNA, 620 bp, Homo sapiens; identical to SEQ ID NO: 136

SEQ ID NO: 182 - DNA, 19540 bp, Homo sapiens; identical to SEQ ID NO: 163

SEQ ID NO: 183 - DNA, 9246 bp, Homo sapiens; identical to SEQ ID NO: 122

SEQ ID NO: 184 - DNA, 44741 bp, Homo sapiens
atttccggggacgccgcgccggactgaggctgtgcgcccgagactccgggtccccaggggctgcgccgggccggcctggcaagggggacgagtcagtggacactccaggaagagcggccccgcggggggcgatgaccgtgcgctgaccctgactcactccaggtaggcgcggggggtgcctggcgaggtgggagccgctgcccgggaggtggcggaccaggcgaaaaccgccgcgcagccgctgcccccacccttgcacccgcacctcccgcccggcccctctccccagaaggcgccacctgcacgctctgatgggcactggggcccgccgcccggggagcctgttgccatggcagcgcaggaggctgggcccgcgttcccatggccaccgggggcctttgagcagcgttcacatcgcgccagtgcaccacccctactcctaaacccgggacctggtcctggggggaagtcatttggaattcggaaaaggcctgggcccctgcggaatggtcgtggatatgacctccgagttaggccctttgtcatggcttctttcttctcactgagcaccaaggtgctagaaggagaaggctagaaggagaaggaagttgaggttctgggcatgaagctgcagttgcggctactcgggagttattctggtctagcagaaaggcgaaggagccctgggtcatctcgggaaggtcatcaaatctctgcccacatttcctcacctgtaatatgggtatgttatttgagttaaacacaggattcctctaaaggttgaaatgccttaaaattttgtgcgggaagcatacaaacttttaaaaagtttttttccccataatgccttagaactggaaaagatgtagaaatcaccttggcccatcccccctcattttcataaggaaaactgaagccagagagattaaatcgcttcccaagatgacagtgagttagtgggaaggtcaggatttgaactcaggccatggccgtttcttttggtgatttttttttttttttttttttttttttgagacggagtcttgctctatcctccaggctacagtgcagtagcgcgatcttggctcaccgcaacctccacctccctggctcaagtgactcttctgcctcagcctcctgagtagctgggactacaggcgtgtgccaccatgccaagctaatttttgtatttttagtagagacagggtttcaccatgttggctaggctggtctccaactcctgagctcaagtgatccgcccactttggcctcccaatgtgcctggtttataggcttgagccaccacgcctggcctttttggagattataccttctgaagctcaggaaaatctaggatatgtctccttgcacctggggctcaaactgttggtgacaggtaatctccatatggggacattggccaggcatggtggctcacgcctgtaatcccagcactttgggaggtcgaggcaggcggatcacctgagctcaggagtttgaaaccagcctggtcaatgtggtgaaacctcgtctctagtaaaaacacaaaattagctgggcatggtggcgcatgcctgtaatcgcagcgacttgggaggctgaggcaggagaatcgcttgaatctgggaggcggaggttccctgagccagccgagattgtgattgcattccagcctggacaacaagagtgaaactccatctcaaaaagcaaacaaaaaataaaataataaaaataaaggccaggcacggtggctcacgcctgtaatcccagcactttgggaggccgagatgggcggagaggtcaggagatcaagaccatcctggctaacacagtgaaaccccgtctctactaaaaatacaaaaaattagccagacgtggtggtgggcgcctgtagtcccagctactcgcgaggctgagacagaagaatggtgtgaacccgcgaggcggagcttgcagtgagccgagattgcaccactgcactccagcctgggcgacagagcaagactccgtctcaaaaaataataataataaaaaacaaaaaaataaaaataaaataaataaagattggggacattggcaacagttgaactaaagatgggaaacggagacttgtgccttggggagagctgagtctccccgctgcatgggtcttgtgccttgaggctcttgctttaatgtagtatctgactacattggacaggatggtccaaagtaagtccctgggagccaagcattcagccactctccaaaataccatctcttctgaagccagcaaagctggtgagcctggagctaagcaagaaaactgtttagcttccctaaagcagggaaatgggactctagtcctgcctctatccgtgtggtgctgtttcctttgaaagggataacagaaaagtgggggaaaagatccaggaaggaaaacgtgaatgaatcctttggaaatgatttgagacagctagagcagaagacatttgctgggtacctgctgtttccatgttctgtcctggggctggagatgaaaaagctgagttaggcaggccttgtccctgcattcaaggagcttgtagaagagaagggaagagagggatgtgatgtgtaagtgagtatttcactgcagcataatgaggtcctaataagaatctgagcagagtgcagagggaactcgcaggagcaactctggaaattagttgaaaacagcaggattctagcctgggagcacttctagaactctgccaagttggccgtggccactacctttgttggaaacaaagcataagggagtgaaagtgtctaaagaaaggtgggggctgggtgcagtgacccacgcctgtaatcccagcattttgggaggccgaggcaggcagatcacgaggtcaggagattgagaccagcctgaccaatatggtgaaatcttgtctctactaaaaatacaaaaattagccgggcatggtggtgcatgcctgtaatcccagctactcaggaggctgaggcaagagaatcgcttgaacccaggaggcggaggttgcagtgagctgagatcatgccattgcactccagcctgggtgacagaatgagactccatctcaaaaaaaaaaaaaaagaaagaaaagaaacgtgggtcaggcatggtggctcatgcctgtaatcccagcactttgggaggccaaggtgggtggatcgcttgagtccaggagttcgagaccagcctgggcaacatggtgaaactcagtctctacaaaaaatacaaaaattagccgagcatggtggcccatgcctgtagtgtcagctatccagggcgctgaggtagaaggatcacctgagccaagggaggttgaggcttcagtgagccatcaatcatcctgccactgcattccagcttgggtggcacagtgagacactgtctcaaaaataaaataaaataaaagtagccaggcgaggtggcttatgcctgtaatcctagcattttgggaggccgaggtgggcggatcacctgaggtcaggggttcaagaccaggctggccaacatggtgaaaccctgtctctactaaaaatacaaaaattagccaggcatggtggcgcatgcctgtaatcccagctacccgggaggctgaagcaggagagttgctggaacctgggaggcggaggctgcagtgagccgagatcgcaccactgcactccagcctggacgacagaacaagactccgtctcaaaataaataaataaataaaaataaatgtagatcaggatacgtattgtctttttttgtttgttttttgagacagagtctcgctcactctgggtgcagtggcgctatctcggctcactgcaagctccgccccccggattcatgccattcttctgcctcagcctcccgagtagctgggactacaggcacccaccaccacgcccggctaatttttttgtatttttagtagagacggggtttcaccatgttagccaggatggtctacgatctcctgacctcgtgatccgcccgcctcagcctcccaaagtgctgggattataggcatgagccaccgcgcccagccaggatgaatattctctgaaagaacagtttaaaggatcctgataaactaagctctgtgaaggcagcaaccacgtcagtttccttaaacttgagcaatacttagaaggcagcaagtgcacaagaaatatgtgttgcatgaatgaaagaaggaagtgggggggaggaaggaaaaggaggaagtgagcgagggcaggaagaaaagggaaggaagggagaggagagaagtgaaggaaggaagaaaaggtaggaaggagggagggaaggaaagaaggaaggataaacattggcttatattatcagaagaggtggatggctataacttgagacaaaacgtggttgatttctgactataggttgaatatccatatgggttctggagtcagcagatctgagttgtggtcctagtcctgacttgtcacttgtgtgaccttagtaagtcctggaacctctctatgccccaatttctcacttctgaaatggcaataataactgatatctcaccctgtagtgagaattaagtaaatgattgaatgtaaaaatttggcacaatcctcacttatagtaggtgctcaataaatattaattagctatataaatgtcaactttgatgtagctggaaagaatttgccaaatatttcatgtcaaggttatataactattccaaactgaggtataatttctttttttctgataaaggctaattttgaaagttccttgtgtctgcagactaacgcaccttagagaaatggttctttactttttttggcggggagtgggggctggtagcaaggagcttttgaaattaaatgaaagctctgattccctctctcctgaaatggcatctcattcttggcgttcacagctccctgaagcccacccgtgtggtgaagggggtccctgctctgctgcactgctcacaggctatagtgaaagaactcaggcagcattcatagaagaggtggctgggaggagcaagcagggtcagccgtctttcaaggggtttgtggaaaccaaaagatgagacggctagagataagcacatgtggccccgtgggtgcgtcctcttagagcccactctcctgctagggccaagctggggctcactcagaaccttgtgggctccagagtccctggtgtggtgcccaccagccggaccctcattcacagtgcataaatggtgctgcagggtggctgctgtgtgagattcctatccaggcatggatctttggtgccaccctcacatcagctttctgtgagtgttgtctcctaataccactgctttagggtggcaagtgggcacactgccacaggtggtgcattcctcagaacctccaccctggcaaagcagggtgagagtacagcctacagagccttaggagatccgtggcaacccgtctgtgcatccccgctacccacctaggcatacctgttcctgcccactctctgggatcagcatcagaaccaagagcaaggctctgtctgggagtaagagtggcagccaccaggtgacctgaggtgatggggaaactccagggtcagagagctcctcctccctgggaaggaagaggcagaggggagagccttgggcctttgggaaggaaggttggtttcctgaggtggagggagggccctggcctgttcctttttcccctcacaggggtctggtgctcagactgggattttagagggaataactcgatagcaaatggggaggtagattcctcacttcatgggatctttggaaccagggtgtgtgtctgtgtgtgtctgtgtgtgtcttgctctgtgtctgtgtcagtgtcttgctctgtgtgcatgtgtgtgtatgtgtgtgtgtcagtgtcttgctctgtcacccaagctggaggtaccatcgtgactcattgcagcctctacctctcaggttcaagtgatccttgcacctcaaccttccaagtagctgggaccacaggagcacaccaccacacctggctaatttttaatttattttttgtagagaccgggtcttcctatgttgcccatctggtctcccctggacaggcgagtgggtgcaaaagcagaggcagacagcgcctcctgaactcatattgggggagcagaggagtgacagtggcaacttcatgttctaccctgtcagggcagggacaggttgagccctgctgattgccccacagccctgtggggcggagggatcccctcccagggagtggccagctcaggccccaacaggccccagtgggggtggtgctgggtgtcaggctcctcaccacagcggacgcacctgggacttgggctgggcgggccggttctttctccccatgagagttgcagcctcagcaccagctttgcaggaggtggctgaacttgagggagtacccagaagggggtcctcagagatgggcatctaagatacttcagagttgttgacgccatggggcaactttcatggggaggtgaaccaataacatagcaggcatggccttgctcactgagcattcactacatgccagtgttgcccgtggctttatatgtactctctccagccacccatgaagtgctgttcatagcactccgtcctagatgaagaagctgaggttcagagtgattgtgtggcttgctaaaagtccacaaaatatggaaggtagtgaattcttctgacagaagaacctgtgtgctcaaccactggattctaccacttccaggagcaagaaaaacaagaggccggtagcggggaaaatggtttggggaacggagatgaagccatttatttacatctgttgccagaccctgggtaaaagctgccagtgagttttgaaggcagtgtaagtgctgacccggggtggatgccctctgctgcagaaggcgctgccccaaggaagctcccagccctgaggacttggcagccattggctgatttgaaagaatacacagggtgtgccagctggtgtcgcttcctcttcaacatgtactgatgctgcagctgagctgctgcccagcccctggggagaagacaccagcagcatgcccagccagggcagggtggagagctgcagctgcaggttggcataagaggagagctcagggctacaaggggatggtggtggggggccaaggcctggagagctgggctgcagccagtgtatgtctgcgaggccttgctgggcagcctgccagtcagcacccgagaatggggaggagcttgagtgctaccccaggagggggcgggtgggacctttgggttcaagctccactgggcttggcaggaggcccctcccccacagccagcaaacaaagcaacaactcccagagtagaactgtgggagctccagagccaggttcccctgggtgggaattagagcaggcagacctggccaggagccgcctggcagggaccatccatgcccaaggacatggcctgcatgcagctgggcagaggctgtacccatggatgattaatgggtattgatcacttgggaggccagatgtagcctggacactgctggcacttgccctgcatctgttccctttgtactgggcagggtagagaagcagcagggatgtgtgttcatttgctttttacttttagccatgcttccctttattttctttcccttgtagctttttttttttttttttttttgagatggaatcttgctcttgtcacccaggctggagtgcagtggcacgatcttggctcactgcagcctccgcctcctgggttcaagcaattctcctgcctcagcctcccgagtagcagggattacagcctcacgccaccatgcctggctaatttttgtacttttagtagagatggggttttgccatattggccaggctggtctcaaactcctgaccttgtgatcctcccgccttggcctcccaaagtgctggggttacaggcatgagccactgcgcctggcctcgtttcggcctctttataatggattcctatacacattcttgtgcttctgtccttgtgtatgtatgtgtgtgtgtatgagagagagaaaaatgaggaaggtccatggggaggaggtgccagagcgtgtgagtgtggatggagaagaggccagctttgatgatgacttcattttgctggccaaggcacggaggaagcagtgcttttctcttcgtctcttattttggtactccctttccaagctgcctcctgagctctttataaacactggcattctggctgagaaagactcgccaacatccaagagtggcaaaggggaacaggagacacatcgttggcttgggaaccgctcccgctcgcaggaagtctgctcacaggagatttttctctgtcagtgtcctcgtgtggtttctagtctggggagaacacatcagcacactaacggaagaaaggggagcccgcaaagaccaaagctgctgtgctgggggcgtggattcgagggctcttctccaggctgacagctgggaccctcattttgtcagccctgtggagttcctactagagtgccatgcaaggcagtggggatttggaagatggaagtcctgtcactgtcctcaaaggacttgctgcccagtcgacataagacatattggaagcatttgagcaggatatgattatccgcttagtgaggccgcatcagcccctgtctcctctgctctgagatgagcacagcagtcacacaactcatgtgttgccaagacaccagggcaaagcagccccactgccattttaggatctgcttgatgtggagattcagggactcaacaaatagtgattgagcatgtggccaacatcaggtactgttctaggtgagtgcagtaggcagaaggtagaagaaggaaatgtagctagtaccttgactttgacaagatttcttgcaatctttttcataatattctttttttttttttgggttggtcggggggacggagtttcactcttgtgcccaggctggagcacagtggcgccatcttggctcactacaacctctgtctcccgggttcaagcgattctcctgcctcagcctcctgagtagctgggattataggtgtgcaccaccacgcccggctaattttcatatttttagtagagacagcgtttcatcatgttggccaggctggtttcgaactcctgacctcaggtgatgcgcccacctcagcctcctaaagtgctcagattacgggcaatgagccactgctttcagcccataatagtcttatggataatatggagaaatgtgggctgaacagtgcagttaggaggacacatagctagttgttcagcctataaaagatattgatcaggccaggcgtggtggctcacacctgtaatcccagtactttgggaggccaaggcaggtggctcacctgaggtcaaaagttcgagaccagccgtgaccaacatggtgaaacctcgtctctactaaaaatacaaaattagccgggcgtggtggcgcatgtttgtaatcccagctactcgggaggctgaggcaggagaatcgcttgaacccacgaggcagaggttgcagtgagctgatatcatgccattgcactccagcctgggcaacaagagtgaaacaccatctcaaaaaaaaaacaaaaaacatattgatctgttctaaccttgatggaggtctctagtggcgtgccattgggctccgtttgtgactctgtctcacccatttatttatttacttacttattttcaggctcccaaagtgctgggattataggtgtgagccaccgtgcctggctgtcacccatttttgtttaatcactcaaaattttaaatggaaagattagtacaaaaacacccaataactcttcacctatattgaccagtttttgccagtcacattcatgttctttctctctagtacatgcacatacatatatatgcacatttgtttttgctgaatcatttgaaagtaagttgtagacatcgtgacatttcaactgtaaagcttcagcaggtgtctctgaaagaccaggacttaatcacatctgagaaatgccattatcatagctaaaaaaatgaagaatgccataatatcatctaatacacagtccatattaaaatttccccaattgctccatggctttttttttttttccaacattcaatcttcaatcaaggttcacacgttgctattgattttgtttgtttttttttagacagggtctcattctgtctcttaggctggagtgcaacagcatggctccctgcagctttgacctcctgggcttaggtgatcctcccacctcagcctttcaagtagctgggactacaggtgcgcaccaccatgcctgagtaattttgtattttttgtagagaccagtttcaccctgttgcccaggatggtcttgaacttctgggctcaagtgatccacctgccttggcctcccgaagtgctgggattacaggtgtcagccacctcgcctcgctgcatttgattattatgtctttttagtcccttaacctaaaacagccccacccctgtctgttttgcctctcactagattgccctttctgaagagtccaggctagttgtcttgtagaatactactcatgctggatgggtctgattgtgttttcattgttagatctgggttacaacacacctttgagaagaatgctgcaaacattgatgatgttttgtacttgttgttttttctttttttgagacagggtctcactttgtcacccaggctggagagcagtggcgtgatctcagctcactgcacccttgacctcctaggttcaagcagtcctcctgcctcaccccccgaagtagctgggactacaggcatgcgccaccatacctggctaatttttgtaatttttgtagagacggagttttgccgtgttgcccaggttggtcccgaacccctgagctcaggcagtctgcctgcctcggcatcccaaaatgctaggattccaggcgtgagctgctgggcccagcctgttttgtacttctctttttttttttttcgagacggagtctcgctctgtcaccaggctggagtgcagtggcgcgatctcggctcactgcgagctctgcctcctgggttcacgacattctcctgcctcagcctcccaagtagctgggactacaggcgcccgccaccatgcctggctaatttttttttttttttgtatttttagtagagacggggtttcaccgtgttagccaggatggtctcgatctcctgacctcgtgatccgcccgcctcggcctcccaaagtgctgggattccaggcgtgagctgctgggcttagcctgttttgtacttcttattgcatcatatcaggaggaaaattacgtcaaatagtcccattactatgatgctacttttgtctaattggttaagattgaggccccgagatctctcccttagagataaatgttccctttggtaattagtaagtcatctgtgggacagaccttgttaacatatagtttcgtaacaatcttccacccaatggtttcccatccactgatgattcttacttgaatctagattttctaattctatcaccatttcttctactttttttttgagacagagtctcgctgtcggtcaggctggagtgcagtggcgtgatctcggatcactgcaacctccgcctcttgagttcaagagattctcctgcctcagcctcccgagtagctgggactacaggtgcgtgccaccacgcccagctaatttttttgtatttttaatagagacggggtttcaccatgttagccaggatggtctcgatctcctgacctcgtgatccgcccgcctcagcctcccaaagtgctgggattacaggcgtgagccactgcacccggcctcttctacattattaaccagcattttttggtaaagaaaagcttccttttcaccccttattttttctctctctctgggtttcactgtggactaatggattgtttttaaatttaatgtattaatccattacttcattatgttttaatgctcagattggtcatcaagctggttccgatgtcctttggacatggcctcattagtttctgatcattgctttctggcccaacaaaatgtctcatgtttatgtcgtactttcccttacattcacccaaagaatcttggttctcttattagagagtaggattaggaaaccaagattggccaggtacagtggttcatgcctgtaatcccagcactttgggaggccgaggtgggcagatcgcttgagtccaggagtttgagaccagcctgggcaacgtggtgaaacccctttctctacaaaaaaattacaaaaattatccgagtgtggtggtgcatgcctgtagtcccagctactcaggaggctcaggtggaaggattgcttgagcctgagaggtggaggttgtagtgagctgagatcttgccactgtactccagcctgggtgacagagtgagaccctctctcaataaaaaagaaaaaagtaaacgaagatttaggtgctagatctgctcacccaatttttgtttttttgggacggagtctcgctctgtcccccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagatggggttttactgtgttagccaggatggtctcgagctcctgacctcatgatccgcgcacctcggcctcccaaagtgctgggattacaggcgtgagccaccatgcccggccctgctcacccaatatttttatcaatagcttgaataaaggcataaggaatggttatcatgtttacagatgaccccatactggaaggggaagccaaatgtatgataatagaatcagttttcaacatgacttcagtgggatgacatctgagccagaaccactagatttatttattttattattaattaattaattaattttttttttttttgagatggagtctcgctctgtggcccaggctggagtgcagtggcgtgatctcggctcactgcaagctccacctcccgggttcgcgccattctcctgcctcagcctcctgagtagctgggactacaggcacccaccactgtgcccggctaatttttttttgtatttttattagagacggggtttcaccatggtctcgatctcctgacctcgtgatccgcctgcctcggcctcctaaagtgctgggattacaggcgtgagccaccgcgcctggctggtaaaactctttattggaccaaagttgatataaaaaaaatagttctggttgtcagctgacatgagtcagcagtattctgtgactcaagttgcattcattcattcattcatccagtacttactgaagtcctgcttaccatgtgccaagcactattctagaggcttgagatacattacttaacaaaccaaataagcaaaaatctctgccctctcagtcagcattctgggggagatgggatgtcagacaataaagaaaaaccataactaatatatcgtatgttattcagtgatgagtgctctgaaaaaatatctcaaggtatttttaaggagataaggggcatattaggaggaagttcagattcttcaaggtgataaatgagcaaaaggaagcaagggactcagtcctgtggttatctagggggagagtgtgccaggtgagggagcagccaggtcaaaggccctgctggttcgggctactatatatgtacctggtgtggatgagtgaggggaaaagtagtagaggatgcagtggtactggtggtgaggatgacatggagggctttgcagaccactccaagtaaggtcattgtgaatgagatgggggaacccttggagggttttgagcagaggaaagccctgatctggcttgtgttgtgtgttgttttgtttaagatggagtcttgctctgtagcccaggctggagtgcagtagcacaatctcagctcactgcaacctccgcctcccaggccccggttcaagcaattctcctgcctcagcctcccgagtagctgggattacaggcacacaccaccatgcccagctaatttttgtgttcttagtagagatggggattcaccatgttggccaggctggtcttgaactcctgacctcaagtgatctgcccgcctcggcccaccaaagtgctgggattacaggcgtgagccaccacccctgtcctggcttgtgttttaaagactcactccagctgctgtgttgagaatagattgtaggggaaccaaggaggaaacggggagaacagttaggaggcccttgcagtaaccaggagaaagagggtggtgcctgggccctagggagctgggaagtggtcagattatagattttctaatggactggatgtgaggagtgagataatgagaggagctgagggttttggcctgagcaatttaaagatggaattgccattaaatgaaatggggaaggctgtaggtggagcacatttttgagaagggggagagatcaggagcttagtttgggacatgttgggctcgagatggttttcagacagccaagtagaaatattgaggccgggtcaggtgtggtggctcacgcctgaaatcccagcactttgggaggccaaggcaggtggatcacgaggtcaggagttcaagaccagcctggccaacattgtgaaaccctgtctctattaaaaatacaaaaaattagcggggtgtggtggcataaacctgtaatctcagctactcgggaggctgaggcaggagaatcacttgaacccagaaggcagaggttgcagtgagtggagattgcaccattgcactccagcctgggcaaaagagcaagactctgtctcaaaaaaaaaaaagttgaggccttttggagttaagggctgagcagggctggactaggcggcagataggggtttgggtatcactggctgtaggtggattgaacccatttagagtaagcatccaaacctgggcaatagtagcactgtgggtgcttggtgctgtccatatcccatgtggaattctgtgtccagttctgggagcccctttaaaagggatgctgctagcctgcaccatgtccacagaaggtgatggaggtacagaaatcatgcagcatgaggaaacttagctgtaagaaaggagacctgggaccatgtgggtgctgtgcccaccctcttgacagcatccctgttgtgggagcagatgtggcagaccctgaaagtcgggaggagaggaaaagaggtgctctgaggaggctgattttggctgggggtgaagaggagctttcctgcaattgcagcaaatttatggagcgatggtctctactgccatggaaataactagcagaggctttcactcttttggactcttaactacaggaggaactactacatttttctgtaatcctgtgcacacttaggaaaagttgaagtagctttcccaaaattacttatcctttgagattattgcttagatagtttctatgttttgtttgtttcttaatgctgttgggatccactaaattgatttcagaatctgctaatggtccaggctgcagttggaaacccctggtctcagcagagctgaactccacccgtggagatgttaggagccaggaggattaggggtgggtgcctctgggcttccactccagtcttaggggttcccttcccctgccgggtcacgtgcaggttgtgaaggttttacctcctcagcagtacattaaatcctattatcccacttaagctaatcttgcccttcccccacccgagggcttcgcgtggacagaatattaagcggacaagcccgcagggtgcctagactaagtgctgagcttgtagtgaatgcccagccatgacttgcagtggattgacctgtgcaaaaattggactctcaagctgctagccccagtgtcagcacgagctcggccgagttcatttggtcgcaggaacaagggggtcgccaggagcaagagcggagggggcgcctaaagggaggagaccaaggcctaatcaccatccgccccctaactccctaggcgcatagcggggacgcagcgtgtccccaaaccaacgccactagcagagggtcccagaggagccggaaggggccagggcctgggcggcggtgggagggtctgagcagtgggggcggggagctgggggtcggctttcgtccgcgtcccagcgctccggcggccgccggggctactgatcccgggcttggcccctgcggcagcgccccgagctgccgcccctcgcgctgccagcgcccgggaaggaggaagggggaagggggcgggccggccgggctcacggccgacttcctccttcagccccgccctccgccgcttgcgggtgagctctgcccaagccgaggctgcggggccggcgccggcgggaggactgcggtgccccgcggaggggctgagtttgccagggcccacttgaccctgtttcccacctcccgccccccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggtgagtgccggggacccggggacgcgggccgggggaaggaaggctgccggggacgtgcctcgtgcggaggtggccgtgacaaaggaccaaggaggggacctgtcggaggcacgggatccattaggaccccttcttttttcaaggcgctgcgcggagggagggagaggagaggggagctgtggggccgctggcccctttcttcagttttctttctgcgtagggatggggtctagcccgctctgtcgtcccccctagttcccttaggaggatgcactttcggcggggtccgcctgcccatctacttgtctttgatgctgaccagagccgaccgcggtgccgcccccgagggcggctcggggtagagggaggccactgcttgcagtcctataaacactggggttctggtattcccagcaagtcgcagcagggccgggagctgtggtgggcgggcaggcgcccgatcctccctctccgcccctccatccctggcttgccagtgcagccccaagccccagcatggagagacctccaggccctgggagcgaccagactgcggatgggggcagctctgggcgctgacattcccaagtcctgggagcgaacagactgcggatgggggcagctctgggcgctgacattcccaagtcctgggcgcgacccctcctcagagtgacctgggagtagcatcctggttggctgggttcctttcctggtcctcacatctgcttctgtggccacctcctgtttcagccctccgcccttccctctccttttcccttccatccggttgcttctccagctcttcttggggcacttgggctttagattcagagggtcctggatcccaagcccatttcttccactgggcaagtaagtgccttctgctcccagtgccccacctttctcatctgcaaaataggcagtcgtaggtgccttgcaaggtgtgttactcgggtatgaagtttataagtgcccaacagatgtatccgcaagccctttaacttgttggttgtcatattgtatgacttggaataaagcatgtatgaattagaggttacagactgaaactgtcccagacttccatctcctcacagcatccccacctctaaaagcatcctgtttacaaagggaaatagtagaatcagcacttaaattaaggcagggccctagcggcttcaagtaaccctacctgaacccctgtctgaaatactgcagatgacctgggttcaaatgctacctcagccacttagtaaccatgtgaccttgagcaggctacttaaagtttctgggtcttgatttcttcatctgtaaaacaggtataataacagaacctacctcaaggtagtgaggattaaatcagctcgtgtttgaaaagtcgttaggacagggcctggtacgggaaccgctgaatgagtgttactcagctcagagtttacttctgtacatcttgcccagatctggggtgattctgcctggggttaggacagggttggggtgttagtttgactgtagccccttgggtgcttcagcttgtgaagtcaggatgaacaggtgtaaccagccccaggcctgctgtcttgctacttctgttgtggccacaactccctttgccctcagaccctctcatttttgggagaaggcagggtgagatgggggcagatgctccaatggactccacttatggccttgggaaagctgggccagctcatgggaccatgtcaaaagacggtaggtttcatgtccaactctggaactggatgggacaatcacagggtagctagaaggcaaaactggagagcagcgaggggaatcgaggggacctgcttcccgaggagcagctagaatacttggttattattaccaatgcagctgcaggacctggtccacttctacaagcccgtgactgttcccaggcttctgtcacgcaccagcattcacctgtcagggctgccgtaggtgggcttgcattttgtgcattgtaccaaggtgcccagctgagggttgagaggacctgaaatgcagtccacactcagctctccaacctaagagtcctggagcaaaagaccccttctgctatgttcttggggctaggtctgcccggagtggcccatttttccagtcccaccaaagccctggaatagtgtagtggcacctagctacctgaacttgtgagcacgtatctatagtcgactgagttgccactataccctggagtgccccctctctgggcttcctcctggccctcatacccacctcctactcttacctacgtgcaggtcctagggctggctgggagtccgagaggggaatgccctggtaactgaacaggctcacccttgagtgtggcctaaggcggtttcctgcctcatcccagggggctcattagatgttcctggcagtgtgcccatcctgggcaggctcgtggtgaccatgggacgccgggcccagggccctagtgccctcccttgcatgcatcttaggagaaagagtcatggaactggatattacacacccctctttcctcctgccactcactcctctactgaattcccacccatgccccgtaaggacccagatgcctagggacagtggggctatgtctgtggtttaaaacaaaatcccttgaagtggagcgtccagcttgccctgcatctggggtccttcatagggaaccctaattattgttgatgaacagcacattcctggggtgcttaagatgcagggagccgatttgtggcctcgcccagtggccagtagggagaggaggatgaggggacagccactgggggctccacagtcagctggaaatctctgaaaggaacacttcaaagaagtgtgtggaatttgggttctcttgcgttggaactaccatgcagagctccaggaccaaagcctcggtcaggagcaggagtggtgctgagtagaaacaatggcgcccagtgcttcccagcctggccacgtggggagaaacaaaacacgcctcctctcatggccctccaaagtctttttgggccaccttatttggacacttaatgggagttattattattgttattttgagatggagtttcgctctgtctcccaggctggagtacagtgatgccatctccgctcactgcagcctccacctcccaagttcaagtgattctcctgcctcagcctctcgagcagctgagactacaggtgcccgccaccatgcttagctaatttttgtatttttgtagagatgggatttcaccatgttgtccaggctggtctcgaacttctgaccttaggtgatctgcccatcttggcctcccaaagtgctgggattacaggcatgagccaccacatccggccttaaagggagttattaattccctcctgccccagaagtgccgggcgggaaagctctggacgcagtatttctgaagcagattggacagaaatctgcaggcctgcaaactgcagtcaacaaaacgccattgagcagagagaatggagcatttggcacaaatcagctgcttgccctctggccctggaggaggcagccagggtcaaggctgccctgggaagccctgatgctggtcgcttgttgagccctcagcccggttactggcttccctccttgacatggtctcaactggacatgagcctttgtccccagctctgtcctatgggccagcatctctttggctctgcagaggtgagtggaaggcgctctaactgcggatgctcagagcctggctttgtaaagtagcttgccacccttactaactgcacaaccttgggcaagctcctggccttctccaggcccattttcacattagcaagagaggaataatggccatcttcacagtgttctgagaggattacatgaaataatgtatgtaaagtgtttggcatggtgcctggcacatgctgcatccgtagtaaaaaggtagcttctgctctggtgtgctagaaaccccctgccagccttgcttggtgaggttatttgcatccatttttgtgcacactggtggtatgcaggccctctgctaggtgccaagccttgtcaggcttagtgcctgccctggtagaaaagacaaagcaaggcccccaggagctgattggaggtcattaccaggggtcctgcttaattatagcccagttattaagtgctcctgattcagccttttcaaagtcctcctttgcctgaagaacctcctctgcatggggctggaccatgcctctccctgcctgcccttcactggttctgctctgccttcagcacaacccacatccagctggtgttgaaatacctctgtgccaacccaggagagcgctaaacttgcacaacttttggggcatatctggatataccagcatgttcatcctctaggcaagagacagagggtggcacggggcctggagaaaaggctagactcgggtcatgtcatcaatcactccttcctttatcttcttagagcctgttgcctctcactccacccccatgggtgctcaggctggcgcaggactcagggggcctctgatgtggccctccctggggatcggggcaacaggaacaacacaacgcgagactcctgtggtcgaggcctgccttccctcagattagctttttgggaagtctgctcccttggactgcattctccatgcttttccccagctggtttccctgcccctcctcttcacattctgacctccctgtgctggatgtgggacagctatcctgtctgtaagataagataattaaaagcctggtggctctttccctgctgccaccaagtcatgcagagacggaggctcaggctcagttgcgttcaagattcggcttcacccgtaacccactgccatggccgaggaaggcattgctgctggaggggtaatggacattaatgctgctttacaagagctgttgaagacagccctcatccacgatggcctagcacatggaattcgcaaagctaccaaagccttagacaagcgccaagcccatctttgtgtgcttgcatccaacggtgatgagactgtgtatgtcaagttggtggaagccctttgtgctgagcaccaaatcaacctaattaaggttgatgacaaaagaaactgggggaatgggtaggtctctgtcaaattgacagagaggggaaaccccgtaaagtggttggttgcagttgtatagtagttaaggactatggcaaggagtctcaggccaagcatgtcatcagagagaacttctaatgcaagaaatgaagaaaatatctttggctcacaaaaaaaacaaaaaaagcctggtgcccacagcggctctatacttattagctcaccatcgaccctcttctgggcactgaatactggaacactaaggggtggctcctgccctgtggcagagatggtcacagaagagtagagtggctacagagtgatacacagaggtggagtgttctgtccagctgctagagttctgcctcccaggcctgtgatctgacttgttgtgcatggaagctctattctgcactcctggatccatctggaagcccatcctgtagtcttaacaggcttccgagaggtggggggcctgtggcgagggggtttcagtggggatggtaggtaggagacagaagccatcattttaccatactcctaaagaggagccaaattagccaactcgtgtcctcttttttggcatcttttggcccatcctctaggaagggggccaactggaagagcaaataaaagcggccattgcggtgcactccctgtgtgccaggcactgctgttggatgtggaagtgcattgctttatctcatgcagatgaggaaaccaaagctcagtgaagctaactcattatcaaggtcatgcagctatagaagagtttgggaccaagccttgggccacagttctcgattcagcaaccacattctttccattagaacagctgcctcctgcttcacctgtgaatcgtacaaaagcagcaagatgacccggctcagcccttgaataattgcaggttatatttttccatctgttaaagaaatctgttgaggtcagtctctggacggggcaggggatccagccgaggcccctggttgcatggccatagttgggaagagggcagagctggcagacatgtggcacacaggagactgaggcacacatctcagacagaagtttgcaaactgaagggtagtgggccacagccagcctggagatacattttgtttgacttccaagttctttagaaaaattttaattaggccaggtgcggtggctcacgcctataatcccagcactttgggaggccgaggcgggtggaccacttgaggtcaggagtttcgagaccagcctggccaacgtggtgaaaccccatctctactaaaaatagaaaaattaactgggcatggtggcaggcacctgtaatcccagctactcaggaggctaagggaggagaatcacttgaacctgggagacaggggttgcagtgagccgagatcatgccattgcactccagcctggaagacaagagcaaaactccatctcaaaaaaaaaaaaagaaagaaaaattttaattagttgctgatatttaaaacttaggaaattttacataaaaatctaggtttccagcttttctgaaggtctggtaaggttggacccccattccgtgtagcagcacgtgtctggggcctaagtcttgcgtgtgaaaaagggctagagtaaaagtagaaggcaagaagcaaggggaggagtagggagcatggggagaacccatcttgattattgatggtcactgacccctaatctttgcagagctttgcactgccacgtactgtgtttatttagtcttctcagcaatcctgcaaggcagccctctcaggactgagaatttgttcggggttgcacagtgggtcagtgatcaagtgaggattcacacacatgtcttgtgccccttccagtccgtgaagcttgtttcttgtctccctaccatactttcagctgtcatacttccacctgtcatacttaattctttttttctttttcttttttttttttgagatggggtctcactctgtcacccaggctgcagtggtgagatcttggctcactgcaacctccacctcccaggcttaagcgatcttcccacctcagcctcctgagtagctgggacctcaggcatatgccaccatgcccagctaatttttgcattcttggtagagacagggtttcatcatgttgcccaggctggtctcgagctcctgtcagctgttatacttctatgtgttcagtgcttttgggaggggtcagagtggtagcagtgcttctcagacacacttttgtgagtgtgatgcttcaggacctccacgttgccccatttttatctggggcccctctctgggctggagcactctcactgggactgtgtcattcatttgtttagtcaacaaacatttatggaacaactgctgggagctcacctgaccagttgatacaaatatgaataagacatggtcttgatcttgaagatgctgtcagcttggtggaaaagaagagcacaaagaccgggcgcggtggctcacacctgtaatcccaacactttgggaggccgaggcaggcggatcagctgaggtcaggagttcaagaccagcctggccaacatggtgaaaccccatctctactaaaaaaatatatatatatatacaaaaattagccgggcatgatggcgggtgcctgtaattccggctactcaggaggctgaggctgaggcggaagaatcgcttgaacccaaggttcaaggttgcagtgagccaagatcatgccattgcactctagcctgggcgacagagcaagactgtcttaaaaaaaaaagagagaagagcgcagaaagaccctcctcatcatcatcaaacatcaaacattgccatcatccgacagtgtcaccagtgcactacaagacgtgtgaacaggaaatgatgggcatacggagaagggcccttgcccagccggggatccaggaaggcctcctggaggaggtggaactgagccaagtctcaaaggatgagtgtgagttagtcaaaaggaaagccttctgggtggaggggacttcctgaacagaccggagatgagagaattgggcccttgagttgcagttccatgtcacttggtcgaaccaagaggtgggtgggtggcaagcactagcaagttaggagcttggacgacggggtgctattgaagtttttaggcagaacagtgacggctcccagagagccctctggctgcagcatagcagctggcctggagatgggaggctggttgggaggctgctgtgatggtggcctaggtgagagaggatggtgccaggctcaggactgcggtagtggggatggtgaggggaatggatttggaaaatattgagagaaaattggcaggatttgattatagactggacttctgaggaaggaggatggtgagacacccaggtgagtggtgccacacacaaacacaaaatgccaagccagggagtgggactggaagggggcggtgaggtggtgggaggcacccacagaggcccttctgcactgtggggtctggtgtgttggaggaagatctgcacttggatgaggagatttggggatcgccagcatccgcgtcattgaagtgatgagcatggacgtgtgacccaggggcttgaacggagttaagaagagcagggccaggagcagacagacctagagagcaagaacattcaggagcaaagcctgaggcaggagggtggtcatcaacacagatgctgcagccaggtggcccagggtcgggcggcatccccaccactcctcccggggatgacttgcacctgaaacagaggtaataaaacacagcagccttgtgaggatgacatgacttaatccgtttaaagggctgagaaagtgctcacatactttagctctttgagggctagaggcccagaaggcatgtgagggagacacggagtgatgcttgagactgggggcacaggtacctagaggacggggtggcgtggcccgtgtctggggtctgtcagcgaggcgatccctgggctcttggcagggctggcactgctgaacgtggggctggctgaggcccaacttctgtggaggagtgagtggaaggtgagaggcagagatggcatggggtggctgttctctttgggagcttgtctaaggcaggtggagggaggcacaaaagtttctagaatggacattggaacaaaaactgctttctgacaggtagagttggtgacataggatttggtctctgaggagatggggtgggaagttgaggttgtttatgcctgatgaccccgatttccttggaagaagtggagacatctataaaagcaggaaggcagacccagggcagaggccctagaagccgggttgttagaggggagccagcccctgagcagagggactgagcgtgtccctgtgtagacctgtgagcaggcaggcggcaggcaggctcctaaggtgacggcagtggtctgtgcacccatggcacaggccctaggtcgggactgggactgcctgggggttctggcagaggctcttcgtctgcccacttggggctgtagcaatggctttccggggcatgccccaggagcacagatgctgtgaggccaggttcccttgccctcgttgccactttcttggtgacctcagtccatgggaggacccttggcacacaatacccccaacctctgcccagagtccctggtcagggactcgactctggcactgggctggtgtcagcagaatgtggccccctcctccatgctccatgaggaagaagtggctgccctgcccaacacgggccgtgtggaggaaggaagtgcacccaggttggcagtgtgtcccagtttcctgctgactgtggccccgtcagcactcctgccctggaggtggggctgctgctggggtaagtgggtccaaggttctggtgacttatcgtgacatccctggggacgaagggctacaacagcctttcaggaggctctctggggacttgtcccgcccagacccctctctgagagtgggggaggccactggctgcctccttgcattggaggccccttccccaccgactccacagggaagctggtgttttctggcctgatcctgctggggcctgtagagggtgggatgttagggccaggtcagcgtcttgctgccgtgcccggagccacagtagagagaaaggtggggtggggttctgagtcacagcgctgctgcagctagctggctggcctggggtggggactaaccagggtggggatggtgctgagccctattcctgtctcaccccagagagctccaggcttccggctgagtcacagggaaggaggacccttacatggggctgagggctgagtattcccacatcacttcctactcagaaccccacttcctactcagaaccccacttcctggggtggggagtggggaccctgcaggtgactcttatgtgcccattccatgtgccgtctccctccagggagggacagggcagccccagaccagccccggtctgcctttttgaaggatgatctgcctagtgggatgcactggccttggtgaagcccctggctgaagcctgtcggggtggagggagagggttcaccctgaatgggaaaaccggccgcagcctcggcgtgccctgctttcttcatactggactaacccactggatagatggatttagaggatgtccgagcagcacaggcagcccaggagagcgagcgagacactctttgacacaagggagagcataaaagcttaagactgaccccaaggtgcgccagcccctcgcaggaagtaaagtgcagaaacacctccacccctgcacaaagagcacctaggagtgagtgcgcaagcgtggacaagccctgcggtaccgtgtacacacacacacacacacacacaccacaggcaagctcaggcagggtccttcacagacgtctgcagtcactctggaggtgacccaagcacctgggcccttagacagtaacaccactcacaccgagcacagaccagctcgcgcccacaacacgagcctgtgacacgcaagtctctgtttctgagctgatgccgtctggctttggccatgagaccctcgtgtgaccaggtgcgtgcctaagttagaatcgcccaggctaagttcgtgaaccccctggatgagggaggcccgactcccgcaaggagccctgcccttctgccagctctcaccgggccggattttcctgcggggcttttggattttgtttttgagtcactcattgagtgttggtcgcgtgccagacaccatgccacactgcaaaccatgtgcaacgttgttttagcaaagctgtctcagtaaatgtgggttattatgtatattattatttacatacgtaatctcattttttctaataacaaccccatgaggcaaagtgttattattttccccattttacagataaggaaaacggggctttgagaggttaagtggcgtgtcctggtggcacacagccagtaagtggtagaggatggctttgaacccaggtctctaactctactctgcacaccatggctttcagtctgactctcagggcagagagatgaggcaagtgtggaagggaagccccagaaggggaaagcctggttaaggggcccttcacccccctctccaaggcacattcccctttctgtccctttgtcgtttcattcactctactcccagcatggctggagggcttgtggctggctcgtttggaggcctgggctgaaccagggactggctggtctataggtttcccctccagccggctgcactctgtagtgcccgaggcaggtttccaccccttctcccaggcgtaagtgggattgagttgccacctgggactgaggcttatctctgactcttggcatttctttgtctggacagattccaagggcggtctgctgcccagacttacagggcctgcccaggtggaaacgctcttttgcaggtagataagcacgggcaaccagcttatctgaaccagcccttgcttccagagaactatggaaaaatccaaaagataagaagggaccgcagtgtctgtcttggtctcactcctcttgagactcctgtgatctttatatgtctcattcctcccgtgacatgtatgagaaactgcagctcattgagacgatgtctctgctgcctgacagaagggcctacttgagggccgggctcggtggctcagccacctgacccccgtcatcctgttaactagtgtcacccccacccgagggcttccttccccatttgctgccaggtgtaaagctgagcttcggctgggcgcggtggctcaggcctataatcccagcactttgggaggctgaggcaggcggatcacctgaagtcaggagtacgagagaccagcctggccaacatgatgaaaccctgactttactgaaaatacaaaaattagctgggcatggtggcaggcacctgtaatcccagcttcttgggaggctgaggcaggagaatcgcttgaacctgagaggtgtaggttgcaccattgcactccagcctggacaacaagagagaaactccgtctcaaaaaaaaaaaaaaaaaagggctgagctgctgggcgtggtggctcacgcctgtaatcccagcactttgggaggccgaggcgggtggatcacatgaggtcaggagttcaagaccagcctgaccaacatggagaaaccccgtctctactaaaaatactttgccgggcgtggtgacatatgcctgtaatcccagctactcaggaggctgaggcaggagaatcgcttgaacctgggaggcggaggttgcggtgagccaagattgtgctattgcactccagcctgggcaacaacagcaaaacaccatctcaaaaaaaaaaaaaaaaaaaaaggctgagcttcccccaaatggctgatatgtgttcctccttatggacattgaggatggagtagcttcatttcccatttttctttggccaccaggaggcccagcactaaaggctcagcccttctctaccagctgtgcgaagactcattgacctactcgtgaatttttacttccttgctgatggagatgtttttcttcagatttgggttttctctgctcctgattttaatgtttatatttcactactttcttttcttcatgtctccccaccctttatggaaccaggctgggggtatgtaaaaacactccacaggtaaacacacatgaagtcatcttcacagctgcttgattgggcgtgttgcactttttgcttcctcagcttcgtgagactgtttgtgtggtcataacccactggtccgctacaacgtgcctgagggtggtcagggtgctgctctttgcttgtttttgtgttctcatcagctgcttagaattttaaaaataatttctctccaaaccctttagttacccaaagcataaacagtaccctggtgggtaagtgtgtgtgtgtttctttttttttttctttgatttatatatttcacattatataaggataacctgcttattagagaatctaaaaatgataacaagtaaaaaagaaaagaaagctacctgtaattctaccagggagcccatgttttagtgttttgtgatacatccttctggatttttttcctatgcttatatttttcccacaaaaaatagaatttgaccatacatactaaatataacctgaattttcacttcatggtagataattcgtgtctttccttgttgttattctgcaaaaacaaaagctacttaaaatgtgtaccaaggtctgggcgcagtggcccacacctgtaatcccagcacttcgggaggctgaggcaggcggattgcttgaagccaggagttcgagaccagcctggccaacatggcaaaaccctgtctctactaaaaatacaaaagttagccgggcatggtggcacatgcctgtaatcccagctactcgggaggctgaggcagaagaattgctcgaacctggaaggcggaggttgcggtgagccgagatcatgccagtgcactcctgcctgggcaacagagtgagactcagtctcaaaaaataaataaaatttgtatcaaggatacatgcacgtatatatatatttttaagtatagaagggcttattataaaaagcaaaaacgtctgtcctccctcaccccaggccaatttaaaagggacttttaatcatttagggttcttagggttcttgttctaccattatttcctccattttttttttttctttttgagatggagtttcactcttgttgcccaggctggagtgcaatggtgtgatctcagctcaccgcaacctctgcatcccaggttcaagcgattctcctgcctcagcctcccgagtagctgggattacaggcatgtgctactacgcctggctaattttatatttttagtagagacgggatctctccatgttggtcaggctggtctcgaactcaggtgatccacaccaaagtgctgggattataggtgtgagccaccacgcccagcccatttcctccatatttttaagtaaaatacttacaccactatttcttggcttatttgaattcctaactttccctcacttacatctcccttccattcctccccccaacatattctgtcaccgtactgtattcacttcctttattggttacctttgcaatataaaacagtacacttgacctgtatttattattccattagccattggcagcagcttgtgacaaccctgctaccatattatgatgtctgtctgtcatcagttctggtttctgaggtcaaaattgaaaacactcccattctgtgtaataaccatcagtctcaaagaccagtgcttttttgggaggctgacgcgggcagatcacttgagttcaggagtttgagaccagcctggccaacatggtgaaaccccgtctctactaaaaatacaaaaattagctgggtgtgatggtgcatgcctgtaataccagctacttgggaggccgaggcaggagaatcacttgaacctaggaggtggaggttgcagtgagccaagatcatgccactgcactccagcctgggcaacagagcgagacttcgtctcaaaaaaaaaagaaaagcccatgctcaacatttgcattactctgtcaatgcaaatagcattcactgcagggcccacttaacatttccttctctttgggtctaatgtcactcaaaggaaagtgttaaatgtattttcctttcttaatattctattatgtgctcaaaactcatcactttatattttagtttgcttgatattttgaccatgcctttcttgcctgtttttctggagcttctaatacatcattttttttcccagctgtatagtattcagttggattgaggcatcataatttattttgacaaggtcccctctggttggacggactctttggttttcagttttttattaatgtgaagggtgccgtagtaagtatccttgtacatacatctctgcatcatttcttatgtaatgtttgagagtccaggaatgctgctcgcccatcaaacctgatccccctgcccccagccccttgccattgccaccctttgccttgctgattaccttcctttaaaccagtccatctaaaggttggtgttaagaggcttcccatgggaggggtggccccaggtaatacccatcttcctctccccaggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggaggtgagagatgttgcctggagctggctaggctgggcagaggaccacagagggaagatggacgggaagcttgaccttctgggtccaaggatgatgcctatgggagaggagggaggctcagcaaaccctccattttgtccactaccttcccctttctcattccccagctgctttggggtgcagacgcagagaagaaacagcagtgcagcttcaagggcaaggacccacaggtgagcccacacctggaagggagctgagctgcaggagggatggagggtggtggacttccatccaggccagaggcgggaggtgggagcagatacagccaggtatggtgggaagggcataagcttctgagattacccggcctgggtttgaatcccagcactacacttacatcgctacgaccttcgacaagtagattcacctgtctaagccttagtgggcccacctgtaaaatggggataatgatccggtctcactgggcttacagtgaggattcaggaagctaataggtgtaaggcacctggctcatagatacaagacctaacaagtcagcttccagcgtgaacagagattgggtggggtgagagttgtgtccctctgcagatggttcctgatgtagcacatctgacagattctggtgtggttttggccaaagcacaggatgaaatctggttcaacccaggttctcctggaggactcatcatcatccctagaggcctcctgctcctgctcctaagtgcagcaggtgctgggtaaggtgagggcaaacgagtgctggacttgggatcaagacacaggttcaagtcctggctgccattctgttattcagctaacattgatgaagcatgcactctgtgtccatgtacttttaggtactggagatttaattgtgaaaaagcaggcttggcacagtggctcacgcctgtaatcccagcacttcgggaggctgaggcaggtggatcacaaggtctccacctcatggtctcctgagtgtctcaggagttcgagaccagccaggccaacatagtgaaactccgtctctactaaaaatacaaaaaacattagccaggcatggtggcaggcgcctgtagccccagctacctgggaggctgaagcaggagaatcgcttgaacctgggaggcagaggttgcagtgagccgagatctcgccactgcactccagcctggatgacagaatgagactgtgtttcaaaagaaaaagtagtcagtttacaaatgttattggcggggcgtgggatggaatgaggtggtcaggtaacatttcattaaaaaagtgacatttgagccaagatcaggagagagtgaggagctgacagtggcatatctggaggaggggcaggacttttgatttcactctgagggaggtatttgggaggccaggggaaggctgagcagagatgtgacatggtctcacctgtgtactaagagggtcactctggctactgtggtagagaagcctccatggggaaggacaggaggagggagagcagtgaggggcgagtgatgatggtggctcggaccagtgagaaatgctcagattccggatgcattttgaagatggagccaccaggatttctgggtgggaaattatggggtatgaccgacaagaagagtcaaggctgactgggtttggggcctcagcgactgaaaagacagaattaatgaaagtggcaagatctcggggggaagcatgtgttttagggaggaccagaaagaagcttggttgcaggtgccagttagataccccatttgaaggtgatgcatgaatctggggttcagggttcagggctgagcagtcctcctgctctgggctgtggcttcatcagctcccagcttggttgggaggggcctgtggcttctgaagaggatgctgctggggaatagtacaactcaaaggggtaggattctgtgccctcacccctaggccgaaggaaagtttgccagtcacaaaactagctgagcccctgggctccctgcagcacacacactctgtgcacgctccactgtgccccagaaaacccgtgggttctttgttcctagacttgagtgccccatccccagtcctgggagcagaggccgggcctgggtgtggaagggggggctcggcggtgccccctggtggcatgcttgggcgtgggactgatatcccctcgctccttccccccagcgcgactgtcaaaactacatcaagatcctcctgccgctcagcggcagtcacctgttcacctgtggcacagcagccttcagccccatgtgtacctacatcgtgagtgacctgtcctcagccctgaggctgacctgggaactgcccctctttctgccccagggatcctgttctgtagcatagacccctgaggaaaggcagggcccagagggaggtttctaggtaccactggcctccaagagccctgaggtcccacaccctggcacaaagcgcagccctgacagccatgtctccctgtgcggggaggcgggggcacatgcggtcacttacccatgaagatcctgtgccacccaggccttgctgccctcttctgcttcttccagcatctctccctctcctttgcttgattctcttgtcttatcttgtacaccccctcctcagcacacacccctagcagagggtggcatttgatgctgtgggttggagcccagctttggggtcagacacacctgggtttgaatcacattgctgccccttccaggctcacatcattttatttcttttttctttttcttttcttttttttttttttttttgagatggagtctcgctctgtcgcccaggctggagtgcagtggcacgatctcggctcactgcaagctctgcctcctgggttcacgccattctcctgcctcagcctcccgagtagctgggactacaggtgcccgccaccacgcctggctaattttttctatttttcggtagagaggggggtttcaccgtgttagccaggatggtcttgatctcctgacctcgtgatccacccgcctcggcctcccagagtgctgggattacaggtgtgagccaccgcgcccggccaggctcacatcattttctaagcctcacctcctccgccaggtgggtctgataatgtgtcccgcgtcgggtcactgtgaggcagtgtggcactgtgtctgggtgaggcctctcctgaggccgactgtccaggttcaaacccttcggcaccgtgtcctggctgaggaggacggcgtccctgacacctgaccccttctgtcccacacacctcacctgcctgcagagttgccttctcctgcacgcctctctctttctcaccaagcctgctcctcattccctggagtgcccctgagcccatgtgtccaccctcctgcagaacatggagaacttcaccctggcaagggacgagaaggggaatgtcctcctggaagatggcaagggccgttgtcccttcgacccgaatttcaagtccactgccctggtggttggtgagtgttgagggcaggatggcttcattgaggttccatgtaggggcacacagggctagagggctagctttggacaggctgagtccatgccatgcttatttccaaggggacagaatggccaggggcttgccttgggtttggtttttccaagttccagcttccttctctgcccaccacaggcaaaacgggcagtgctggggtcactctgggccctgagcagggagaaggggccgtgctgaggagcccattcccatgggaatgttttcttggcagatggcgagctctacactggaacagtcagcagcttccaagggaatgacccggccatctcgcggagccaaagccttcgccccaccaagaccgagagctccctcaactggctgcaaggtgaagtcctcttgccaccacccagagggcagggatcctgttcacccagccctagaagggggcactttcccccagcttggcctgtctccagggttcctgggctgactctgagctcctgacctggtccctacagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaaggtgaggggaacgggctgacagggtggccaccccagggacctcaaagcctccacagctgcaagatcacccacatccatgcatggcctttcccatcccgccaaggagtacagcttggctaacagcttttctctctcaccttttaaattaaaatatcttactacttttttcttttttttttttctttttatttttagacaggatctttgctctgtcacccaggctggagtgcagtggcacgatcacggttcactgcagcctcgacctcctgggctcaagcagttctcctacctcagcctcccgagtagctgagactacaggtgtgcgcccccatgcccagctaatttttgtattttttgtagagatggggttttaccacgttgcctgggctggtctcaaactcctgggctcaaacaatccacccacctcggcttcccaaagtgctgggattacaggcatgagccactgcacccagccattttttttcttttcttttttttttttttacttaaaaaatgtgaaaatagccgggcatggtggctcacgcctgtaatcccagcactttgggaggccaaggtgggtggatcacctgaggtcaggagtttgagaccaacctggccaacatggtaaaaccccatctctactaataatacaaaagttagctgggcgtggtggtgcacgcctgtaatcctagctactcaggaggctgtggcaagagaatcgcttgaacctgggaggtggaggttgcagtgagccgagatggtgccactgcactccagcctgggtgacagagcaagactgtctcaaaaaaaaaaatgtgaaaatagaaaactgtacacacaaaaatcacttacaagttaaagaggcactgtagcatcagctggagagcacagaccctggaggccaactgcccaagttcaaaccctgctggcctaggatcttgggcaagtccctcaccccctcggttaacagtttcctcttctgttaaataggaagaataacactgacctcagagttgttatgtgaattattaatccacgcaaagctcttagaaatgtggtgggcagtgactaaatgtgaactatgaatgttattaccccaccaccccagcacaagaaggagtcactggtatcattttagaatgccccctccaaatctttttttttttttttggcatatgtgtaactctgtgtatatatatatatacatttttttttttcctttttgagacagggtctcactttgtcatccaggctggtgtgcagcggtgagatttcactgcaacctccgctgcccaatctcaagcaatcctctcacctcagcccctcatgtagctgggactaccagcatgcaccaccatgcccagctaatttttttgtatttttagcagagacagggtctcaaactcctgagctcaagtgatccacccgccttggcctcccaaagtgctggaattataggcattaataatataagtaccatcccgaccttgtacttatattattaactcactcaggaacatggcattaggctatattggggtcctttggcttccttgtttgctcagcagtgaatcgcgtccatatttaggaaggctctgcttagttacagtaaggaccatcctcctgatggatgcgtacactgctcttcctgactttagatggaacttggtcctggccttctcctgcccttcagtcctggtgtctggggtgggtccattgaggcagtcctgtgccgtgcatccccgtcatggctcagcatgtgcctaagcccagcccatccgactctccctccagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggtagggcctccagacctcgctggagatggaagggtgaagggtggctgggactggggcccccagggctcctgggttaatctggttatttcctctgcaggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcggtgggtactggctccctgcacccagaaggggtgccgggaagatgtgggtccccacaccatgctgggagcaaggctgcctagcctcgggcagatcacttggcttctctgaatctcttttctcatctttaatatggggatataggcccaggcctgcttgtgtactgggttagatataagtatgaatgtcagaatatcttcagttctgtttcaggatacaagtgtgtccccatcagggcacttgctgcaggctgttacaatcatctcttcatttggtcctctcccctactcagctgcaagctccttatttaattatcaagtgactgaatgggcaagctgtggggaaataatcctttcttcctcccttctagcctaacgggctaccctgatagcagaccttgagacaaggatatacgtgccaaatagtttattagggaggtgatgccaggaagcagcatgaaggaataggaaggttgagaggaggagggagggaaaccaaaagagggtgtgtcagcacgctgttgttgctgtgggcagctggagctgggtcctgctggagcccctgacagatggtgtggagcacctctcagaatttcaggaagcctcaggcggggcaggaaagaactgccgactgcactgggacgctctgcccggccagggcttcctgagagcactggtgaagggtgcagaggagcagggagtgtggtcctggttcttgaggcccctgggcatatgaggctggggtggtgggcagggaggaggcacagcaaggaagccctccaagcactcggtttccccgcaccctgggctttgtccttgctccctcagatgtgcacactggctctgtagagcactgccagggatgtgccctggctccgggcggggggacagacaccgctactgtccactggggaagcagggcccgcatcctgcctgccaccccgaggtgtggctggcctcacactgctgctttctcctccagtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtaagtgtctgcagcccagcaggctcaggggaaggggtgcacgtggctggtgggtcatgggcagtgggctccacccagggcctgagtcctgtccacaccccaggtgacggccggctccacaaggcagtgagcgtgggcccccgggtgcacatcattgaggagctgcagatcttctcatcgggacagcccgtgcagaatctgctcctggacacccacagggtgagcaggccaacgaggaatcctggcagggtacttggggggtgccctccattagcaccaagcagtccccacccagcttctcctcccttgcctcaggaggatggaaagataaaggatccagtcatgaactattagaaagtggggtcgcctgttacgtaacaggcctcttgggggtggctctgggaggcatacaagccgggtggccatgggtgatggccctggctgcccatgcccgcttctcatccccgtgtctggctgtgcaggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggtgagcactcccaaaggccccttcccatctgtccagccctgcacaggtgacctcggagcaccatcctgggccctccttgggaccgccacacagcctcgtttatgtccactgtctcagcataattattaattagctctcctgcttcctctcaagtgcaattcagacaggaaattgtgtgtttatcttggctacctgtaaaacgaggacatgatttggtaaagtatgaaatagcacagctttgaaaagccttgcaggaaaatgtggattagcgtgtgaacgtgctttagtaatagtagggctaggaaacagtccattaacaaacccagtaaaaattggtttcagaataacctatttggattataaaatgttcatttagaaaatagggatgaacacaaagcaaaactacccctcatcccaccacctagagagaatcgcagtgagattttgatatattatcctctcaggttttactacatatgtgtatagataacaaaaatccttttattttatttcatttcatttcatttatcttgtttggagactcgctctgtcgcccaggctggagtgcagtggcacaatctcggttcactgcaacctccacgtcctgggttcaagcgattctcctgcctcagcctcccaagtagcagggattacaggtgcccgccaccatgcccagctaatttttgtatttatagtggaggcagggtttcaccatgttggccaggctggtctcgaacttctgacctcagatgatccacccaccttgggctcccagagtgccgggattacagccatgagccaccgcgtctggccaaacattcatatattttatataacattggcaactgtcctgtttgtagtgttcttgcttcacatatggatacacctggtgtcagtttttacaaaaaccaagtgagttttggtgcgtatgccaggagggacaccccagaatgttaactgtcatgatcactggctggtagatgctgtgatttttgtagtgttttcatccttcgtgcctggttgacttatctgtctcctgagtgtatccagaattactgtcctttattttttattacacagatgtatgcatgtgcactgtttaaaaaaaaagatgagaacacatcaaaaaaaattttaattaaaaaaaagaaaaagagagatctatacatacagatcccagctgtccttctaatctttttctgagggtacatactattttttattattattttttgagacagggtctctctgtgttgctcaggctggagtgtagtggtgtgattacagctcactgcagccttggcctcctgggctcaagcaatcgatcctccaacctcagcctcctgagcaggtggaaccacaggcgtgcgccaccatgcctggctaatttttctattttttgtagagatggggtctcgctatgttgcccaggttgtcttgaattcctgggctcaagcgatctaccggccttggcctcccaaagtgctgggattacaggcgtgggccaccatgcctggccactgagggtacatactgtttatgtaattaagggaagtgttatcttagctttgacttgaaataatgtgtagacagaggagatgctgactcctgtgggtggggaatcagctcaggaaaggcccttgcccaggcccaagtctgcagtgaggggtgagggaatgtgagctcaggggacttcctggccaatcccagaattctctctggccctcaggccgtggatccaggacatcgagggagccagcgccaaggacctttgcagcgcgtcttcggttgtgtccccgtcttttgtaccaacaggtgaggtgccccctcaaaaggtggaggagagaggtggggacaagtgtgcttggaaggctcccccaggcacagatgttgtaaatgcctttcctcacttccttgccccctacccctgtaagcaggtccccaggaagactcagtcccaggggtccccggagttgcccatcgtggcaccaggggcatagcccagagggaggcaggggagcttggagctactgtggacgctggcacccccctaccccatgccttttctgcctacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 185 - DNA, 40696 bp, Homo sapiens; identical to SEQ ID NO: 124

SEQ ID NO: 186 - DNA, 26896 bp, Homo sapiens
ccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaaggtgagctgtagccctggcccgggctcccgcctcgggctgtggccctcgccctcctgcggcagcgagaagggacggggctgggtgggggccgagggtccgtggcgggcggcggagggaacagaggcggctgtcccagcctggcccgcgcccgcggatggctccttcctccctttgccaccctcgaggtcccaggaagtttggccaccccccgcccaagctctgagcagccgtggcggtgccacctggggacaagtggttgcttgtgagtccccggaggccgctgagggcacaaaggcaacattcatcctcgggactggcagccgggccctggggcaggggcaggggcaggggcccaagtttcctcccatttccgggaggctttcttcttgtagggtcagtggcacgatggaaagggctctggatagctccttgggagacttggatagctcctgccccggcaccaagccgctgtgcgaccttgggcaaaaccctgcccttctctttgctcctcgatgccatggaatgaggaggttggaccagatgatgttgaagggaacacctccgtgtgtgaattccaggctccccccatgaggcactgggttggtgttagtttgagctgagaccagccgtcccctatcttgcatcccagacccctgcctggttcaggacttaaggtttatgctcctcagaaggcaagaaggtgagcctggctttgccttggcatctgtgacaaggagggggcaacagtttgagggcgggaccttcctcttcacgaactaaatctcttatctgtcacccctggggagtgaggaggtcggctcttctctgggcaagagccgatagggtctggccccaagatttggaggctccacagctggggagttttccatggctgggaaaggtggggcggggggcagatgtatcctgccactggcagcagtggggaggcaccagctccataaagcctctgtcccaggctgggcctcccccatcccaggaaggctggacagggaggcttcagattttactgctgactcgcaggagaggtcaggcagagaagggattaggtggtgattaaactggagaccaggggctggttagggtccttggagaggggtagcttcatgcctgcagtttggaggagcagtttccctggtgcactgggagctgctttgtggggtgggatggtctgagtccctggctgacctaggcaaggggcagaggtggccagtcctcattagtgtcctctgggactgccctctaggtcagtggtcagggaaaggtgaatggctgggagcaggaggctcagggagggcatataggggcctgttcgcctaccagggagtgagaggttggaggtaggtgtggctgtccattgaggtcactgtccacctcctttgtttggcactacctgcactttcccgcttcctggcttcccctactggaactgttccctccacctgagttgcccacctctctcccccgctgcctttgaagtccttcaagcccagcacaaatgccatgttttataggaagccgtgtgagaccacctctttcttccctctgctccccagcaaactcctcatccttccatggggcagaagaccatggtggaaagagtgtgtgctctggactcagacagacccgggtttgcatcccaactctgctaatgactagctgtttgaccttgggcatgttacttagcctctctgagctttaattccttcatctgtagaatggggacaatacttctacgggttgtgagtgaggagtaaataagctatggtgccaagatcagcgctgagcgacaggaaatgcttggtaaactgacagcttttactgcagtccgtatcagagtgcctactatcacgattagctgggaacacatctgcctgcccgcagactggtgtgtgggagcccttgttgtggggcaggggcagtgtctcactcccttcccacttcctgccctgcaacctggcaccccctgacaagacagtgctccaggcagcatgagtgcccagggagtgtctgcagagttgaactatgttaaagagaagtccagttggccgggcgtgggggttcatgcctgtaatcccagcactttagaccgagatgggcggatcaggacgaggtcaggagatcaagactaccctggctaacacggtgaaaccctgtctctactaaaaatacaaaaaatagccaggcgtgttggcaggcccctgtagtcccagctacttgggaggctgagtcaggagaatggtgtgaacccgggaggcagagcttacagggagtggagatcgcccaccgcactccagcctgggcgagagtgcgagactctatctcaaaaaaaaaaaaaaaaaaaaaaaagaaacaaagaaagaggcgtccagcaaagatctcagtggagagtcctaggcagagggcagcagtcagggcgggccctaccactcaccccgatgcctctccctacagtttcgggagaatgtccaggatgtgctgccggccctgccgaatccagatgactattttctcctgcgttggctccgaggtgagggaagaggggctgcgggaggctggggcaggggcttgttctgggcaacagaatagcaccctctgaaaaccctgcccttggcaattgaggcatctagagtgtccaacctttagcgccaaagggcccttggcaatgacataagctcaaccctcctagtggataaagacactgaggctcagagaggtcaagtgacttgttccaagccacacagtgagcgaactgcaggcagagaaaaggggagagtccaggtcggctgacccttggcccacagccttttccatctactcaagaaatctgctctgctgatggagttggggaaattggctgaagaaaaagtgagaaaggccccagccatgtggggggtcggaggcagagccaagtgtagaaccagagtcctggcccctgctatgccctagtgtgatggcaggtccctgcagaccacagtttaggcaacttgagggaggggcagagtgcatggggaacctgaggggcacagcctgacctagagtgacaagagtctcctcaaaccaccaccaggctctagagcccaggtcctggttccagctcttccccagcctggctgtggtgccttgttcagggtaaatacttccctaggatcctcctctggaagagcaggacaagacctgcctgctgcaagacgtgacatgacagaactctgcatgtggtgttgaaatgcacacatttctactggcatgagggtcaaattcagcctggtgccccaatccctgagatgtttccattccttcccctcctctcctttcctgtgattcaggtcatgtgccaccctccctgattcttctgacactttttttcccctctatatagaaattttattaacagacatagaaataataaagaaaattccattatggccaggtgcggtggctcacgcctgtaatcccagcagtttgggaggctaggcgggcagatcacttgaggccaggacttcgagaccagcctggctgacatggtgaaactccacctctactaaaaaacacaaaaattagccgggcatggtggcgggcacctgtaatcccagctactcaggaggctgaggtgggagggtcgcttgaacccgggaggtggaggttgcagtgagctgacatttcgccactgcactccagcctgggtgacagagggagactccgtctcaaaaaaaaaaaaaaaaaaaaaaaaaaaaagaaggttacctttttttttttctttttagtagagacctaggtttcacgttggccaggctggtctcgaactcctggcctcaagtgatctgcctgccttggcctcccaaagtgtggtatagaatcatatcctaaaatattaaagtacaaattatgccctattattttaattttaatttctttttttgagacagggtctcactctgctgcccaggcaatgggcatgatcgtaggtcactgctgccttgaactcctggtctcaagtgatttatttatttatttatttatttatttatttatttatttagagatggagtcttgctctgttgcccaggctggagtgcaatggtgcagtctcggctcactgccacctccacctcccaggttcaagcaattcttctgcctcagcctcctgagtagctgggattataggctcccaccaccacaccggctaagggtttcaccatgttggccaggctggtctcaaactcctgacctcaggtgatctgcccacctcagcctcccaaagtgttaggattacaggcgtgagccaccacacctggctgttatttttattttatatttttatttttattatttttattttttttgagacagagtctcactctgtcgcccaggctggactgcaatggtgcgatctcggctcactgcaacctccacctcccagtttcaagcaattctcctacctcagcctcccaagtagctgggattacaggcatgcgccaccacgcccggctaattttttttttttttgtatctttagtagagacggggtttcactatgttggccagcctggtctcgaattcctgacctcatgatccatccgccttggcctatttttacttttgaaacagggtcttgctggcctcaaactcctgggatcaagtgatcctcccacctcagcctcccgagtagcttggcctacaggtacacaccactgtgactggccctattatttctttatggacacataaagacatgcacatgcacaccctaggagtcttggggcagatgaagagatgtattttccttttctttccagaaatttcacagagctggcacgctcctgagaggctgcttgtaaacatctgagggcagatccatccaggagcctctggaagtgtcacttgcccctttccccaaaaaagcttccataccatccccctaccccagtccaccgcccagagatggtggaggggtagtgtgggggcggcagtggaatcagttcaggctggaggaaattttggcccagcatttgctaaagggctgcagctagaagcaggtgggtggagagagtgggaagatagtagccttcttaaagggccagttgcaaaatgatccagcagactagggagctgctgttgggggagaagcatggtttctgagagccactgaacagcaacacagctctcttactgaggcaggggccagccaggggtcctggcagctggtctcctgattcctggggagcctcatacttcaggcacaccctaccccctcacagtggcggtcattcaaagaatgtggtcggtcattctcatttgccagatgagaaaacaggctcagagaggggaggggacttacctgaagttacagttaatgcgaagcagaatcagggcagaaacctaggactccagactccaggccagtatcctttccaggaagccacccctgctccttaaagccaagctcagcctcttacaacagaggaagtgtctcctctgcatttcatttgtgcctcacatttcctgggcaggagctcaggcctggtcagaacctaatatgaatctcaattgggttttttttttttgtccctaaaaaaaacccaaaacccaaaaaacaacaaaaaaccaaggcctggcatggtggttcatgcctgtaatcccagcactttgggaggccaaggtgggaggatcacctaagcccaggaattcaagaccagcctgggcaatatagcaagaccctgcctctacttaaaaaaaaaaaaattagctgggtgtggtggcgtgcacctgtagtcccagctactcggtaggccgaggtgggaagtcacttaatccagtagtttgagactatagtgagctatatcgcaccactgcattccaacctgggcgacagagcaagattctgtctcaaagaaaataaaacaaaacaaaacaaacaaaaaaacagccttttctctttctctccttcaatctgacaaagacctttcataaaagtcacacacgggcagaatgtctgtccctaacccaggtgtgtgcttggggctcctctccctccctttctccactgagggcttcagttttctgctggcttccaggcatggagagcaggtccgcaagtctcctctgcttccccctgactgaggctgagttctgggcaccccagcaagaaggatcagagagcaggataaaacaaggaagtggtggaagccctgggagggaggcagagcgggtctgagtctctgcattttacaggtctagggaatgaatgaaccaccaccacccagacagctgctcctgagctgggttcttgcagtgccccaagccatgctttgagttgcccctgaccagggcagcaggagcctggagaggcctcaagcaggcatggggaggcctcaggtgtggtactgccaagagcaggtggcaactctgggagagccctcacagaagatgctggatgttgggccttggcagataagggttaactggagagcctccccaagataaggggctcacagttcgccaccactcctgttccctaagaagataagggttctggctgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaaaaaaaaagaaaaaaaaaaaaagaagataagggttcttctcacaatagtggtgtccttcctatggaagattctcattttcatggcccaactcccccaccatgagaggacagtgccttgcatcttccaagtgtttctatcttatcagatgatttggtcagagatgtacagtatcttgtccaaggtcaagcagagaaatgaagagctgggatgcaaacccagaagatattcctctaaaagctgtcccatgctgccatggcagcacacaaaaaagggtgggattcagttctgccaggacgtgtccggcacctgtgatgggtgtggcattgttcaaatctcttgagggagcctatgggcccaggagaagggactgattttcataacggcagagtcagggaatgtgctcggcactcccagagagcgatggttaagggaccggtgacagtccagagggcagcctgtctggcccaggttccacaactgtcagcaaatctagatgccaaatccacagaggacatacaactgggagggacagttcataggtcagatggcaaaattgatctgaatctggatctcaaaactctttgaaggatggactgaagttgactgtaacaagaggaaatttgatagggaaggatctaaggtctctcctctccatgtatgcaatggaggcttagcagtggcacaggtgaaaaggatttggggggtttcagtgcctataagctccacctgagttaagggtgttgcctgttgccaagaaagttcttaggctgggcacaatgtctcatgcctgtaatcccagcactttgggaggcccaggcgggtggatcacctgaagtcagaagtttgagaccagcctggccaacatggtgaaaccccatctctactaaaaatacaaaaattagccaggtgtggtggcgtgtgcctgtaatcccagctactcaggaggctgaggcaggagaattgcttgaacccgggaggcagaggttgcagtgagctgagattgcaccattacactccagcctggatgacaagagcgaaattgtctcaaaaaaaaaaagaaaagaaaagaaaaagagagttcttagacaacacttggggctctgcgtggctcttagagcacactctgagggggctctggaaaattggaaaacactcaaagggaagttatttgcatggacttcagaccaagctgtggggcttcgtaaagtctctaaggatgggcagcacgatggtaggggagatgcagagtgaaagcacagaattttccagtcttggaagtgttgtcatgaggctaaggaggcaatcctactctctgagtgtctctgaaatgaatctcaactcagtatcaatcagctgagtgcaaattgcagctatgattacctgggagcaagtggccttgggggtcagtgaggtctttgtgttcaagcttgagcaggacaacttttggggcatcatgcataaagaggtgacccaggtgaaactgaattctgaaacttgtcaggagccctgggaggcaggccctttgtgtggctttagggaatgtgtgggccctttgaggacatgacaaggttgggtggaggctcatcaacccctctatcccactgggatgttctgccagctctgccacagattacaggggcagctatattcatctttgttttttgtttttcttgggatgggatctcgctgtgtcacccaggctggagtatagtagcgagatctcagctcactgcaaccttcacctcctaggctccagcaatcctcccacctcagcctcccaagtagctgggactagaggtgcatgccaccacctgtagctaattagtttttttgttttgttttgttttgtttttttggagagacgaggtctcactgtattgcccaggctggtatgttcatctttgaactgtggtgtcaaggtctcaggattggatgtgagactgtggaggagataaactttgtgcaagggggaaggccaaatgataagaggatccggggttcattttcactgagaggacggaagacctttaagttgattataaccactggagtaaagctctcttgaccctgaagttacaatagctgcccccagctgccctgaactttgacctgctctcctcgcaaacctggggcctgtggtgccccagaagttctcagtaaaggctctcatgttagcttctgcttgtaggatggtctgagggttagctggagagatgactgagaggaactggccctatcatgggaatatgggaatctccccatccttggacacccagtcctgctaacctaaccctgaccagaactgtttccctgttacagccagaagcttcgacctgcagaagtcggaggccatgctccggaaggtgagacacatttggctgttgcttcagttcctccccatcagaatcactccttgcgtggacttcttttgccgcacctcccatcccaatcacagcttttggctttgagtattagccgaccactgttgccttatccctctgggacaaattgcattcccttccctggcaacacaggctttcatagctctgggccagccaagaatgataatctgttctgctaagacctctaaaacaggcagggccttcttttccattcctgcctaatgccttctggtgaccacttatgatctggtggtccattcacgctgtcgcttattgctacatgcctattaaacctcccccaccatccctgctttttgttttcttttttatttttttctttttggagacagagtctcgctctgtcacccaggctggagtgcagcagtggcgcgatctcagctcactgcaacctccgcctcccgggttcaagtgatttcatgcctcagccacctgagtagctgggattacaggtatgcaccaccacagctggctaatttttctatttttagtagggacgggattttgccatgttggccaggctggtcttgaactcctggcctcaagtgatccacccgccttggcctcccaaagtgctgggattacaggtgtgaaccaccatgcctggctgtccatccctccttttaaaaatttccccattgtatctttgtagcatgtggagttccgaaagcaaaaggacattgacaacatcattagctggcagcctccagaggtgagcacaaattatcccacctcatccctatgctaggcctttcagacccacaacctgggtcctggatccactggatttggatccttagaggaaaggtctgacaatgcccactgagccctgatggtctccagaatgggcatctgttggtacccaggagagggaggtagagaaagatactgatgaacctggagtaaggccctgtggtccaggcaaggtatggatgcctgctgaccaggtggctcctctgtgtctttgcccaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaaggtgagtggaccaccatggctagaaatgagttgaccacagcagaggcattccagcagaagcagggatgtcacacaggaatataagcacagcttcagggccaaggcccagcctttttttttttttttttaatttttaaaacttttttagtagagacggggtttcatcatgttggccaggctggtcttgaactcctgacctcaagtgatccacccacctcggactcccaaagtgctgggattacaggtgtgagccactggacctggccgaggcccaggctttgggatttcctagaccagtgacatttccaagttttagaatattcccaaatatctattttgccatgtaaggactttaaaacaatgaccatctattgttgccatcattaacacccaaaactataagaatggcaataatctcagatgaaaaagcagtcctttaggaagctgcagtgagccaagatcgtgccactgcactccagcctgggcgacagagactccatctcaaaaaaaaaaaaaaaggagtcctttaaattgaataaatttagcttcataaaaaactcactacattattgttatttttctgatttatatggggacccagtgaaatcttactgtggaccaacccatccttgagcaagtatttgggtaccactggtgcaaatgatgtcagattcttgcttctctaattctgtatttaaaaaagataaggatggctgggtgtggtggctcatgcctgtaatcccagcactttgggaggctgaggtgggcagattgagcccaagagttcaagaccagcctgggcaacatggcaagagcctgtctctacaaaaaaaagtaaaaaattagctgtgcatagtggcatataccagctactagggaggctgaggtgagaggatcacttgaacttgggaagtcgaggctgcagtgagccgtgatcgcaccactgcactccagcttgggcaacagggctagaccctgcgccaaaaaaaataaggatagctgattcccttactgagaaaaagactgaagaacaagcaggagctgccacttccctcctgccctcctctcagcagttgtaaagatccagtgaaatgatgtcataaagtctaggaacattcccacactcatctacaaatgttcacagagagcctactgtgcgcagagaccctgcggagctggggatgcaggaagcattagacgtggatgcacccctgagggttcagggtgcacagaacgtctgtcctcgggcataagtggctctacgggtaccgtgcacagagcacacagtgactcaggaagggggaggccatcaggccaaactgcagaaccaaagccatctcagatgtcatctagatccacccagtcatgtactggaaaagaacacagagacctaggcaggaagagtgactcgcctagaccacaattctggcctggggtgattatctcagtttggaaaactctaggtccggccctaactagctctgattgctctctggatgcacagtgcaatcatttggcctggactggaacgggcttctgaagtaggacagcctgacaagacttcctgctctctgttccctgcagttggggaggaaggtggagaccatcaccataatttatgactgcgaggggcttggcctcaagcatctctggaagcctgctgtggaggcctatggagaggtgaggggcaggggtggggaggaaggggacagagggaaggggaggaggagtagacccctctcctaggctgtcctgtgggatgggtgaggcaatgggggcagattctgagcctgctggaatcaagagtgattttgtttccacagtttctctgcatgtttgaggaaaattatcccgaaacactgaagcgtctttttgttgttaaaggtaagttgggaatttcttgtgataaagccagatggaaaagaggggtcaaaaacatgactgcggcagatggagggtcaaacagtgagccaaaagagggggtctgaggacatgttcagaagactgctgcccctgctagtgtgctggctcacgcctgtaaccccagcactttgggaggccgaggcaggaggctctcttgagcccaggagtttgagaccagcctgggtaacacagcaagacctcatctctataaaaaagttaaggaaatgagctgggtatggtggtgcatgcctgtagttccagtttctcaaaaggctgaggcaagagcattgcttgagtctaggagtttaaggctgcagtgagccatgattgtgccactgcactccagcctgggcgacggagcaagtctccatctcaaaaaaataaaaatagggctaggtgcagtggctcactcctgtaatcccagcactttgggaggctgaggtgggcagatcacttgaggccaggagttcaagaccagcctggccaatatagcaaaaccccatctctactaaaaatatggaaattagctgggcgtggtggcccacacctgtagtcccagctactcaggtggctgaagcacaaaaatcacttgaacccgggaggtggaggatgcagtgagctgagagctcactgaggctgaggcaagagcactgcttgagcccaggagtaaaaggctgcagtgagctatgattgtgccactgcactccagcctgggtgacagagcaagactctgtctcaaaaaaataaaataaaaagaacactgcccttcacatacgcagactactttacaactcacagagctttcagtatttataatctcctttgagccacccagcctgatgagatgggaagagaccatttgattatatccactgtaaagatgggaaggctggacctcaaagatgcccatgctgagctgcacaccctgggctgcctatgtgggctccagagccctggggaacatgtggcccagcatgggctggcaggagggtagcaggtgctgcagaggacgctgttagggacagactgggcactgctcccagcctcacattatctggtctctgttccagcccccaaactgtttcctgtggcctataacctcatcaaacccttcctgagtgaggacactcgtaagaagatcatggtcctgggaggtaagtggtccagactgttctcaactccaaaggagggtctgtagcctaaatcgggtccagctttaggggtgtggccgtagccaccagggtgaaagctccctctgctagtttgggagcagtgggacccaggagcaagctggggtggagctagtgccttcttctgttttcctaagaactctttctctcagacactctagaagcaagcactgggtccattattgtagattcaaagatgaatgagactccagtccttgccctcaaggaacttacagtataacaggagacagaagacctagaaagagaggctgggtgcagtggctcatgcctgtaatcccaacactgggaggctcaggtgaaaggatcacttgaggccaggagctcaagaccagcctgggcaacaaagcgagaccctgtctttactaaaaaataaaaaatagctgggcataatggcgtgcacttgtagtcttagctatttggaggcttaggcaggaagatcccttgagcccaggagttcaaggctgcagttagctatgatcatgccactgcactgcagcctgggcaacagagcaagaccttgttttttaaaaaaagacctagagagagaaagctatgatataaactagaaaagacagtagactagtcatagagagggtgccatagaagttgcaggagcaaggttgctttcagttggggaaaactaggagcagcttcatttgacaagcacatagtatgtgccaggcctgagctactgccaagactacaaagatgaataagacagagtcctggctgggcacggtggctcatgcctgtaatcccagcactttgggaggccgaggtaggcggatcgcttgagcttaggagttcgagaccagcctggccaacatggtgaaaccccatctctgctaaaaatagaaaaattagccaggcgtcgtggtgtgcacctgtaatcccagctacttgggaggctgaggcaggagaatcgcttgaacccaggaggtggaaggttgcagtgagccgagattgcaccactgcactccagcctgggcaacagagactccgtctcaaaaaaaaaaaaaaaaaaaggggtcccttgaaggtcttttggcctctctgggaaagcagacacaaacaaatctatcagtatgctgtggtaaatgtacagaaggggaaaccacaaagtgcatgggagcactcagcgggagcacccactccacctgagctaggaagggggtgatgcctacctaagctgcgtgctatggaatgagtaagagtctgccagatggagcaaggcaggaagctgcttggcagaaagaagagcattgaacaaagaccttacatagcatggcagaggcagctgttatagaatgtgaggcagggtgtggcaaggtatgaggctggagagggaaccaggagtcaggccccagagaatcccgggcactaggttgaaaagctgggatatgactctacaggccactgggaatcagagttttcagcaggggagtaccacaaattttaaaccaagacacagtactagcaagattgcgaaggctaccagtttgcacgagcctctgtctctacaaaaaaaagtaaaaaattagctgtgcatagtggcacataccagctactagggaagctatagatttgtttgtatctgccttcccagagaggccaaaagaccttcaagggaccccctttttttttttgagacagagtctctgttgcctaggctggagtgcagtggtacaatctcggcacaatgttgtcacagtccacgcaagaggtgttgcaagcctgaatcggggaattggcaacagggatagagaggagaggatggatttaagaattatttagggccaggcgcagtggctcaggcccataatcccaaacactttgtgagtgtttgggaggcccaagtgggtggatcgcttgagcccaggaattccagatcagcctggacaacatggtaaaactccatctctacaaaaaatacaaaaattagccaggtttggtggtgtgtgcctgtagtcccagctacatgggagggtgaggtgggaggatcgcttagcccaggagttcgaggctgtggtgagtcatgatgggtgccactgcactccagcctgggcaacagagcaaaaccctgtctcaaaaaaaaaaaacaaacaaaaaaacaaaaaaaaaacaaaaaaaacttatatagaaagtaaaacagcagaactcaattgactagatgtaggaagtaagggagaaagctagaatgagctcctggtgtctggcagaggtgactgagagatggtgacgcattagttcaactggggaaaacaaaaaagcttgaagttgagcttgaggagtctgtgagatataaaaatgttgggaatacctgagtttgaagcttaggagaaaactctggtctggagatttgggagttatcaaataacagcagcagctaaaaccttgtcagtacgtaagactgcctacggaggaacagaggcagaaccctggggaacatccgagctcaagagcaggcagagaaagcgaacccagcagggagactgagaagtgattaatgaggttggcagagaagcaagtcaacagggaatggatatgcagggaagtaggggcaacatcagggtacaaggaaaagtgtgacccaaaacccagcaaagaggacacacaggcatcaagccagccagggacaggcaggagttcagttttgctgaagtggagtggagggagaaaaggctagaaaggtagattgggcatccaggtgtggtggctcacacctgtaatcccagctactcgggaggctgaggcaggaggaccacttgagcacaagagtttgagaccagcctgggaaacatagtgagacaccgtttcaaaaacaaaacaaaaaggtatattgggacaggctcatgaaagggtgaatgccacctatggcactgaactttgggggtaggtaagagggattctgaaggcttcacaatgttcatcttttggtgacacacgagaattggagattttccaaatgtatgctagtgagacccggggagtgaagtgaactcatcagggaagtgtaggacttctgggttccagacttagctctggcagcaacaagctcaagctctgttttttttttttcttttttaaatttaggtccccacaaaagcattcttttttcttttttgagggagccttgctgttgctcaggctggagtacagtggcgtgatcacggcttactggagcctcaatctcctgggctcaaatgatcatcccacctcagtctcctgagcagctgggactacagccagcacacccacctaaatttttatttttggtagagacgggagctcactatgttgcccaggttgatcttgaactcctgggatcaagcaatcctcctgcctcagcctcccaaatcactgggattacaggcatgagccactgcacccagccagctctctgctttttgttgcctcagttattctctctgtaagatgggaagaatcctcctggccttatcccaactctccagctggactgggggaagaactataaaagctgagcaagaggtttttatgatttttgttttttctgctgctaccacccaccatgggcatgagacggtttggtttcctggcagcagagctgtgtaggaggttcagtctgttcccctaccacacctaaaactctttcaaccaaacctgcctcaggctgggaagatacagaattttcaacagaggggggagattcactcgggctggtcactggagcttagcagtgcagattaaatcaccccaagaccacagacactgtgttcccaggagttgcatggtctttggtccctaaaaatctgagggctggcagactctggacagtttctgcgggtctccagccagcatgacactggcttgtaccccagggcctggagctgctgcctatatatgctctatatagtaggcataggcaggttttagtatcaaaatattgtacctggctgatatttgtgaatttggattggtgaagtggttcttagcattggctgtgctagagtcaaactctcctagacaggaaggagcttgggtattttaaaaaaaaaaaaaaagagccaaattactggtggctcaacagctgaaaacaatgggagcagaagtgaaatggtggctggggtaaagccaagaatccatttaaggggtgactctacagagatgcatttacttattaagtcacgacttagctgtaggggaaggtgggggaaagacacatagttctgccctcacagtgttcagtataatcaggacagggtatgtgcattcaggccttcctgcccgccacacgtgctgtttcctctgcatggaatgtccttctaccctttctttgtcccctctcctgctgtacttcaatgtatcacctccatggggtaataacatactcttaacgtgtataaggcactttatggtttaaaaagccctctcggccgggcgcagtggctcatgcctgtaatcccagcactttgggaggccgaggtgggtggatcatctgaggtcaggagttcgagaccagcctggccaacatggtgaaaccctatctctactaaaaatacaaaaaattagctgggtgtggtgtcgggcgcctgttgtcctagcttctcaggaggctgaggcggaagaatcacttgaacccgggaggcggaggttgcagtgatccaagattgcgccactgtactctagcctaggcaacagggtgagactctgtctcaaacagaaaagccttctcaagtacttagttcatttcactcccaccataaccaggcagggcaagaatgtcacttagctgttcagacacgagggcaggaaccagggtctcgatttctggcctggggcagagccatcctctggctcctgctgaaccccctgcagtactatgcatgcactgtgtgctcctaatgcaggaatttgaggcggggtgttgtggggtgcaatggatgggttttttctgcctctttagtgtagaccactagggttatggcgaaatcttacctagtgttgagatacatctttatccttccttccctctcctgccagcaaattggaaggaggttttactgaaacatatcagccctgaccaggtgcctgtggagtatgggggcaccatgactgaccctgatggaaaccccaagtgcaaatccaaggtatgagccgccagaggctagaggtgaacagggatgcctggctcaaatgcacattccagttcactccatgccatgcttctagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtaggggcctgggcccttccaggagacccgagctttcatctataggtcctgataggtgggctggaataggagaagccctggtgccaggaccccggagagggcacacacagacagaattatgtctcaattggtgatatcccctgcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctgtaagtatctctgccttggcaatgccttgaagccccatgtccagctttctgcctgtgaggttcctcttcctccatggatttttggctctgagtgttagaactagaagtggaatgccatcagttcaatcctctccttgtatagatgaagaaatctagccttggagacttgtttatggtgacccaactggttaacagcagggtgggactttgatctcatactcctaggtatgggtgagtcacagtcctaggcgatcacaggggttcaacacgtctgctttctggtccaggtctaactgggtctgtgactggacagatatttcttggggatgctccttcccagaggtcacagagacagaactggctgggtgggcatgggatcacaaggtaagcagatgctcaaaagtgcagccttcacccctgagtttcactcatctcccagctgaccaaagaatggacacagactatgagcaggcagtttacacaagaatataagaatgggaaacagacatttgaaaaggtgcttaatctctcttaactttgtaataccattaaaattccccttgactcagcaattctacttgtgaaaatttatcctacagaaatacacaaatactcaaagatacaggaacaaggatattcccggtagcctgggaaactggcagtaaaccatatgaccatgataaggtctgttaagtaaattacagtccatccatacaatgttaaagagaataaactgacatgtaaactgtctgggacatgttaaacaaataagcatgaaacacagcatgtatggtatgtacttactttggttaaggaagtgtgtacacagaaaagaactctggggaaatttatgctaactctaacagtggttatctctgggatgataggatgtttatggagggctttcatttttacagtatttctgcaaatatattttatgatgactacgtattaatattacatttataagcagaaaaaccatacctacactcccttcaacacccacaatcaaatctccagtttctttttgtcagagccaatggaaaatcaatcagagcaaaggctttatcatcagagctgagctggacttgactaaaggctagctccatggcctttggcaagtgacaaaacctaagcttcggtttccggactgctacactggggtatctcacagggatacctgatgatttgatgtgataggttctgtgaggcacttagcataatgcctggcatagagcaagcactcaatgcactgcagtcaccactattattgttaggacaaggcctgtgggagaagggccatcctgcagacaatgccgggagatgggagaagccctgtgccccatttctacggtagtaccagcactaccaggagatctgaactagcctcacagatgtcttggcctctctgcttgtctacatggtcacccaacctgagattttgcctccttcctcacatcccaggcacccttcatctccactgccccctcctcacagatgctctgtggtaccatatagctcctgggggaggcggaatattcttattagtgagcagccgggtcctgggggagaaggtgtatactgtgtgcttcagcaagaacaaggcttagcaccagcccagacaatgtcacccacagaggagaaagcacttaatacatataagcttgaatttttttgtctgtttctttgtttttagtagagacgaggtatcgctgtgttgcccaggctggtctcgaactcctgggttcaagcgaccctcctgccttggcctcccaaagtgctgagattaccagcatgagccaccatgcccagccttgaattatttttttaatggatggggaagctggggcatagagaagggatgttctcccataaagtagcttatgtagacatcaagacagaagacatcagagaatcctagagtcctgatccagaacctcttggccattgactgtcctggatgtgtcagagagtgtggaatcccagaccagggaagtaattgacccaaggtcacagagcctgtaggagagccccaaaccattttccagcatctgcccattacccctctatcttctctttagtatctgaaggacattgcccaagaagggaacatgaaccttttaacataatcaggcttgggcttgcaaacccccaaatttattttagttccttctggatacattcccaaccagaacctttacctgcctgcagggtcttgtctgggatctgctccttgcccattcccaagaggagcagaggcaggccacaggatccattcccccttcccaggtacaaagacaatgaagttggaatcagctgttacctggtgccacagctaaggttagatgtgagcccagagagaacccagtattagcttgcaagctcatctgcgggagggcaatgcccttggagaaccaggagacccctggaaagcagaacagtcatccagtggagaaattaaaactgtgccagcctccaatggcaagagcacattaaccttccccaggcttctctggtccttatcccagtgcactaaattaccaaggaggaaaaccaaagtttgaattgatttcgcttttgttttctcacctaatatttaccaagggcctactgagtacagaatactcaactaggaatgaaaagattcccaaagaaagatctggactttgtccactagaagtgcacaatgtggtcagaagactggaaacactatagaaagggtgagcagtgctgtggtgaaaagagcccagccaggcaccaggaggcctggtttctgagtccagctttgccaatgactctcccagtgttttcagcaagtgtctctattaggtttggttttccttctccttaaaatgacagaagtgatggccgggcgtggtggctcatgcctgtaatgccagcattttgggaggtcaaggtgggtggatcactcgaggccaacagttcgagaccagcctggccaacatggcaaaaccccgtctctactaaaaaatacaaaaataagctgagtgtggtggcgcatgctggtaatcccagctacttggcatgagaattgcttgaacccaggaggcggaggttgcagtaagccaagattgcaccactgcactccaacctgggtgacagagagagactctgtctcaaaacaacaacaacaacaaaaagagaggagtagaccagagcagatcttaatgtggggtcccccggagcagtggttctaaatcgtaaagaccaaacacttcctctttacagcaaatagtgtctaaaatgtcccctttactattctgaagtgaaattcaaaatacagaaattctgaatattatatcccaataatataacccatcctacctacacatgtaatttaaaaatcaatataatctcctatggtaatagaaaagagatataaaagggaactaatttagaatatatattttttcaatacatgaatgagagggtaaggttgtacctttcccattgggaaccatggccccagaggttctacagtgggctccaggaaatctaaaattatgtgcctttttttcttttcttttcttttctttttttttttttgagacagagttttgctcttgttgcccaggatggaatgtaatggctcgatctcgactcactgcaaccttcgcctcccaggttcaagtgattctcctgcctcagcctcccaagtagctgggattacaggcatgggccaccacgcctggctaattttgtatttttagtagagatggggtttctccgtgttcgttaggctggtcttgaactcccggcctcaggtgatccacccgcctcagcctcccaaagtgctgggattacaggcgtgagccaccacgcccagccaaattgtgtgctttcatcagattctcaagggggtcagttacccaactaaagttaaggagccttatcctggagggtgtctgggggctctgtgagtctatgattagtgtcaaaatgaaccatgcagactctggagctgcaatgactccacttccctctggcctgtggttctctgatcaacccctttcttgtttctgaggccaagtatcttgctaggcagggccattatcgacctagtacttggtgcaatgaatgcaaaggacctctcctccagcatggctgattctggttgctaagactctatcatccagggcagagatgaagcttcactcttgccagagggactattggctctgaaagacctctagtacaggggaaaaatagatgactaacaccttcaccatgaggaaagagtgggtggtgtgtctaccctttgtctaaactatgcattttgtccagggtcaggaaaaggttaagtcttaggattaaatacaggatattttttttcttgctgagaacagtgagagaagaccgggatagggatggggcagaactagtgtttttgttttcacattcagttctcctgaagcggtgtttggctgaaatggaacaacttctcaaagaaacagggttagattaaaagcagcctgttcctctgccaaagtgtggaagctttctctgccaagtgcatgcccattttctctttccagaggaaaccactgctaatgtctattatcctatcaaatatcttccatctagaagcattacatgtttccataataaacagggcatacagtgctcgctttgtcagcacatacactaaaattgaaacaatacagagattagcatggcccctgcgcgaggatgacaatcaggttatcttaaataaataaatagaaaacaggacatacacaaacacacacacacacacacacacacacacatattcacaggaattgtctgtcattcactgtatgtttgaaggaattttgaaactgtcaaactcatcgcaggatttcaggaaactttcccattaggacaagcaccagagtggtatcatcagagaatctgggagtctaagcagacaaagaagtaaagccaaaagtatttttacctatgtagttacaaaaaagttacaaactgtttacatactgttctgcaacttgttttggcctcaggacacattgtggacagtttcctgtcacttctgtggagctaacctcttttttaaaaaatatatcagtattctatcacatggattacaacataaaattgttgaagcaattctcctttgatgaacatttgagttttcccaatctcttattattacaaatagggatgcaacgagcatctctgtccatttacctttttgcaggataaattcctggttcacaaagtttgcacattttaccttttgtcagaaattgaagagggccaggttttccagggtccaagtcaggcagaacaaatgcagcaatgtggaacagacggaaactccagctctgtcatttcctcactgtgtgtcaccagagtcacaccacctcctttttatcagctataaaacaggactactgctgaactcgtagagttgggggaaagagtgagataacatatagattaccaacccagtgctgcgacacacagctattattgttattacaactgctactgctgctgctaattctcctccctcctttcaaagtccagttcaagctctaactcctttaaaaagcgtttcacatgatttcagtctaccaggccctcttcttccaagctggtacagacgagatggtctctgtcactcatctggcacttggcatgttctgcctatttttttctctccatgaatgtcttgtcaaccccgctagattaagtttcagaaggtcaaggatcattacctaggctaccttcatccccatgacctgccacactgccttgctcagtcactaaacatcaacaaaaatcactgtccccaagccctttgccagaactgcctgaatgtctgtctggtttctgccttccctcagatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctgcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgca

SEQ ID NO: 187 - DNA, 11936 bp, Homo sapiens; identical to SEQ ID NO: 102

SEQ ID NO: 188 - DNA, 143526 bp, Homo sapiens; identical to SEQ ID NO: 111

SEQ ID NO: 189 - DNA, 408236 bp, Homo sapiens
aggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccaggtgagagatgccgtttgccggggtactgttctggaaggatggatgaatagttctttcgggatggtgtgggagaaagggctggatgggagaagggtctaccatgtggccagggaagggaaccattccccttaggccggcaggttgggggatgcgcgaggagagtgggccggccggtgggtgtggcccgggtgccggaggtttgccttaagagctcttcgagacctgggatggcgggcacgtctgcagcatcttcctggggaggaggaaaggtcgggatgttctcaaaaaacgtgtgcatcgctggaaatgtgaggtcctgcatgttgaggtcttggccccaagaagccagtatccgcagcagcagctgtgtgtctgtctggcggttccgcagagattctgttccggacaaggaatgatctaaggccccattgggttcgacgccccctagcctggctgtaagatccaggaagaaaaggggatcgcgggtggcagtgaacctgctcttcccttggcttgaagatgacctgtccctgccccatcctgcggggtgacgggattccgggcaaggtgctgggactgcggtactagtgcaccagctgaggccggcagctggagactcctagcgccttggctggctgttgcggtgggggtgggggtggaggtggctgcctcagaatggcggccgaagctaagcccctccttcctgggtggtagatcctggtgttggtagcccgagtgacggggcgtggggatgggagatggcttgaagagaattggtgactcctacctttccagacagagcctgcatccagacaagccctggccgtgcaatctcttttacagaaattagcaagggccaatcaggttctcttggtcctccccgctccatttcccccttcttctggtaggagggggctatattttcttggcagtcagtcagcagggacttttggggacaggccgacctgacggatgtgactgtccggttaggagaggcgggaagccagaggggaggtggtttggggctggtgtcaggaaaatggcaacagaccagctgacctttttggcacatacttccctgctgacaccatctccaccttctcctggagctttctctgatcagaggctagagctcaacacgttcctaggctttctgatgcgggaactggagctgaagctaattgtaagcagacttttggaactctgggctggagaaggccctcaaagcagattaagctcccacaccaggctgataagcatgccccttgctgctgcacttgctaaacatttttggaagctgacaggtttgagtgatggtgtgtgggaggaaggcaagatttcctccagtgctccgggggcctgcctctgtgagggttttgtgctctgctcttcttctgttgttacgtacaggatttgtccagtgggctctgccatgggggtgagcaccagggtacacttctgcatggggtttcccttcatccatggacttggggtttatgaggtgtagtgggcagtcggtgggaggtcagtacagtgactcgggactggaggtgacacataccctcgagcctgatgaggagcacccgaggaatgagagggaaagtccatgctgggattgttcatatccaggcagctgttctgcctttgcccgtttgacccttcatttaacaaacattgtcagaggactggcagtgcataggctctggaaaggtgattcatcaccctgtccgtgaaaaaaaatgttcttcagcttctctctgaggggctggaacagtccacttccctcaagactttgcttccctcttttgcccttggtccataatccccccatttcacctctctcgccctcaatgggcccttgtgtactgatggtgaacatagtttggatggactgctaaggaaattggccacttccagtggactaccctgatttttacctgcctgccctcgtttgccagtgcccaggggttctgggggctcttccctgtggcagatccctgtctgcacagctgacatcaaagtgattttggccaatgggattttaccttctttgccagggcttctcccacagtctgcctgatagggtacccattccccctccaaaacagtctcttggttatggcatgaggactgtgtctgactggccatctggtagtttccaggtcccaaatttggtatatattattagaagatactcaggaaacaatgaattaaatggcaaatgctctcttggggcccctgactccccttttattcaggggatttttggcaggagattgggttgtgtagtggctgataacatagcttttaaagtcagatgggtatcgctggtgtcttgcgtctgtcatatactagctaggtgaccaccttgattaatttctttgggctttagtgttctcatctattaaaaaatgagcatgaacaaccattagagttgtgagcattaagaaaaataacgtaaagtgttcagtgcagtgtctggcaaataaggaacacttaataaaagtagctatttatattgctaacctaagagatggggcatgctgaatcaacattaatagcccgtaaatgagaaaagatatggcttattctctcaagcccctggaaaggtatcaatctgttccaaggatctgtagaacatctatcacctttctagtacagtaccaggcagaacgggaagatgagggaagggcatgtccactttctgagtgcctgatgggtgaggctctttacatataatctcatttcatctttacagaaacacttaaatcaggtctgatacatccattttctatgacagtaacaacatggtaacaataataacaatggtaataatggccaaatccttatatatcactttctatgtgccaggaattgttctaaggactttacattaaaaactaattttattcttattacaatcaaatgagataaatgttattatccccattttacacatatgaaaactgaggcaaagaccagtttggtaactttgtgagtagcaaaggtagaattagaactcgggcagtctggcactagatcccatgtctttaaccatgatattgtacagggagaaacacagagactgtcttagaacttgcaggccctgatttataagaccattgctgtaaccattgagctagatgaggcttagcaaggtacagccacttgctctcggtcatccagggtggcagggcagggagtccagcaaggttggtctggctttgaggcctgcggtcttcccactcttcattgctttctttttccatcctgctctggcagatctacgaggcaaataggacatggcctgggccttggggattttataatctagttgggaggcataactgatatacacagggcaacagggcacaacacagggaggcctcagaggcatgcttggggctgggtatccaaggtgctcaaaggaaaggccaagatggctggagaagtccagagagcctctggaggagacagaagatgagctgaattttggagatgggaaggacagactggtggggaggagaggaagtcagaatgaatgtgatagtggagaatgaagagcaaggtcatgcagtggtaccgagcagttgatgttgcttcatgcaacaagtcattgctccagatctgacatcttccctttcaaaaggtgatgaagagaaagaacaaaggctttgcagctgaaggattggatttgcatgttggcttcctggtggatcatcattctgaatgtgcagggtagttgtgagaagatccggagagggtgtccgttaaggacctgattcagattcataacagatcattgggaaatgatggtgattattatttttagcttggggttcagaatattcaacgtggtagttacaggggaaaggaggctattctgacaccttgttttattatgcagcaactttcttcagccagtgacatcccattgcccctaagcctgctcttcatctccatcaagtgtgaaaagacctaacttagccagcaagtagctgttaggtacagccctactgtcacccacccttcctccaggccccttaccttgagtctctcccataaacctacagctggttctcccccacccacccccacccttcccagtgcaggaaactgtgttctgcagcagcagcacacctcccctgaattaccttcctgggactgagatacctgtgccttcccccaagtatgaacatttatagcatctgctctgttaacatgtgaataaattaggaccatgtgcagagagctgttttaaagacacgctctgtgtttgttcagaaactctctctggctgaccttcagataagtaacatgcctgagctatttgaggagacattagcctatttttaagaagcagttgcaaggaaaaaaagaaaaaatatatacatatataaaatattttgatatttcctgtttttagcagctggtgttcaagttgcacctagtttttttaaaaaagtaattagaagtgattgaacttctctgtgggtgttttagatgttgaaaaagaaagcatagaggaggcccctgggaagagagcgcagctctaagcttacaacctgtggcaactttgctccattgtgttttgattagaatccttgctccatcatcaaaggtgattatggatttgattagtgcatttttctgctattgtgttactccctttcttctctttctcagttcttggaggggaatgtatagcatggttatctgccaacatgcaagaatgtttatggttcacatattattgcttactccatgggttaattttctaaagacactttaagggtggtactggtggcttattcagggtaacattacatgtgtatatatctgtatataaatacatctacttctggatatgtgtatatatgcatatatacacacagataacacaaatatatacacatggaacagcttaaagtattgagcacatataagcacacacacacatcaaaggggaggctggaggagttacggcccaaattctagctttcagaatagctaggtttgctttccatttctcattctctcttcctctgtgaccaagatctgaagcaccaaatctgggtcccatattatttacttataagatataagggatgtagccttcagagaggtgttttcatgaggccccagtggaactcttggaaccattctgaaaaagtcaaaccacccagcgagattttggcttaaggtcagaaattcttagttctcagaatccgcctcagcagcagggaagggaacatttatggagcatctgctatgtgccaggtagtctgcggagctctttatatagatattatttaatgtgaggcacaagaagctggataaaatggaaaacggtctgtgcattttttgtgagaaagcagaggccaagggaggttatcacttggaggcagttttacgtggtaaattcgactttattgagaggtcagagtttgcatctaggctttgggcaaattatagaacatccctaaacttcagttttgtcatctttgaagcagaaatggtgatgcttataggttgggggtgagggttcagtgagatattccaggtaggttcctgaacacagtgtatggcacatactaagctaggaatatatagtattgcctatttttgttacctaaggtcagatccaagtttggaaactatgtctgcctcattccaagctcacgttctttccaccctacctctctgcctcccaagtacgcagctgagtacatgaaaagacagacggcttgcaccatgaaagtggagggcatagcagggctttggttagatgaatgggtaaattaagaacaacgtcatccaaagaagtcatatctcgagttgttaattgaaaccttcacaggttggtcccagacatgccatctttataacagtaaccaagctgagggatccgctacaaaccaaacttgtgggaagcttcctttgtacaactagtctgaactggcactgtagaggtggttgagtggagccggccaatctgagggcctagcccaggacaggaccaagaatggaacattttcattgactgggcttcttaatggttcctcattgttctgagggcagaaggaaagcccttttttctcccagcaggcatggttgtaatgagagctggaccttgtgatcagttggccattaaggtgccccaaggcatggccagctgcccaatggtgctttaccaataaccacaggccaaattcaatgactattctgtctcttggtcacatttttcaaagagatggacaatgtgttcctagaatggcttgggcagaatgggccatgtgattttgggaacaaaacttagctaggctttttgtgctttaatctacacaagacaatagtgagtgacacaaagttttttgcaggaacccccattcgcccacacagagccagagaatgactcatggcttagtgccccctttcccagggaatacagatcctctcttgtgttttgcaaacaatgggcccccagcctcagaatattttgcctcttcttccaagtgaaacctcaacaccttcagtgaattttgggttattccaatccttccgttcatcttggtgggacagaggatagggtagaaatggggtcttagtcaagataattgtgatcccactttcagcggtctttggaagactttgaacaaaattagctactcatggcaatgtggcactttaaaaataattataatactagtcacggatatcgattgagcacagcctctgtatcagcataatgcatagcaccagatatgtatcattcatttaatcctcacaacatcccatgaggtagatgctacttcctgaagagaactggaaatgaccactctaggacttagcaactttggttctaattctgtctctttagtcaccttgctacatgaccttcaacaaatcacattttctttctgagcttcagtagcctcacctataaaatggagaagatagtacctgctgtaccttctttgaagttactatgaagattaacacaggtaattattgtgaacaaggcacctgtttaagcatcttacactttaggtagcccttgaggaaaccagggctgacagaggtgaagctacttttccaaggagcacagctggtaggtagacccaaatatttgaacgcttatctgtttgacctttgaagtcaaccttcttaaatagcaagtgtgaaagcactttgaaaaaatatctgaaaaaatgctgttactactgagtctaagtaaatcactttcaaatttcctttagcttggtaatacatatgccatttgactcctccccctgccctagagtttggaaatattgaaaatactctttcaatgttaagtaagtattagttgcttatagttgcttaatcatattggttgaacccttttgggatgtttaaaatttcaagtcctctgaggccacaaggcccactaaacgtcattgttgagtgttaactggccgggctgattctagacagaggaaggagaaaatgaggaatttgattcaaaatcacttgttggcatgaggaagcaatcagataagtttagattatgaatcattatttaagacaacaggccagggatcttcaaaaatgtcagtgtcatgaaagacatgaaaaagttttaaagcaggtgaaggactcttctagaaaagagtaccaaagctatgacaaccaaatccgatgagagattcttgagtagctcctggatgaggaaaaccataaatgctacaaaggtcatttgtgagaaaattggagatatttgattgtagattgtgtattagatagtattattctatccatttcaatggtattggggttatgtaaggaaatgtcctttttcttgggagctatatgctgaaatattagaagggaagtatcttgatgtcagtaagtaacttaactctcaattaggaaaaataaggtgagaacatctgcagaaagaagaaagaaaatgcaaaatgttaacaactggtgaatctaggcaaagatatatgtgcacgtctttcaacttttctgtaggtttgaaatttttaaaaacaaaacaaagtcctgcctgaatagtatttgtcaccgatgcccctgatatttatgagaacataaatgaaataggagtgtgtgtatgtactcacaatagcctggccaaatttgtttcatgaggtttaagttctggactctttatcttctttctggtatagtgtgaaaactttggcttaattccttgttctttcatgagaatggttgctgacattttctggaaataaatcacaagattcagtttcatttggtaatcttttataaaaatctaaggtgtttccaaggttgcaaatacaaaataaattttttaaatgaagtaattttttaaaaaaaatttaaaacctctgactgagccctgctggtctaggcactgagaaggtaaggagtatgattggaagcaagcttttctcttttgcctgactgaatcctcccacactttacccacacaaaatcagtttagtgttacctcctccaggaagccttctgccaccaccatggtcctaatacagtgtatcttctatgtgttccatagcctggccattagcccctcagcttggactgcgattgcttattttgctggaccatgacttccatgaggtcagggctgtgtctctcctgattcctgctggcacaggatctatacataataagtttttagttaatatttgcagaagaaaagaagggtaaggggagataaaagaaagcattggaaaacagtagtaaatagatattgaactcgagctgtggatggatcttgcagaactccctcttaggatgtgaactgagaaggtcatgtgatggtgggtggccaagcgtaggagacagagacacagagtgggcaacctgaacactgtctggagccagcatcaaagctctccaacaccaggtcttagggaaacttgcctggtctggctgagtagagggcggaggcagattcctttgcacaaggctgtttatgatatccaaactctctggctgctgcgatggaagaagagctgtgaggatgtaataatggcactgcagcagactggaggggttgagagggagataacaccatgggctttggcaagtttgggcagattcctgccccccacccccaaccgcccctaccttggatggaggacctgagaagggttctgagggggttttagttggttaggaaagggagaaggtttagaaaagcctaggataggacagagtttccaggaatgatgatcacagcaaccatttatgtgccatttccttacataatctcatttaatcctcaaacgaactttctgagctgatattattgaacttactttaccagtaagaagaaaaataggagacagtgagaggactagccttagaggagttctgggacttttttgggtcacacagctggtatagacagtgtgtggcaggatttgaactgaggtctttctgattcccaaacctgtgcttttaaccactgccttcttttgccagtaattgaaggaggcctgagtcccatatgagctactgctttagataatcaaacctccagaccctcctcttcttggagcctactccctgcttccctggtctcggcccttcttgctgcttccccctcgttggggccttctgtgcctgtgccagcttgttgccagaggctctgtgtttataggatgaggagccctatttggcctttgcccacatcctgctgcaatctgggcaggatctccttgtcctactgctgtggctgctgtcccccaggtgacccccgtgctgccggcccagcagggtccatgtgcctaacagctggcaggaccttgttcctgtcctcctgccacatgctggctgcagctctgcagacagtccccatttcatgctgatttgctttgattcttttcagacctgggagtgactcatgtttacttcaaaatgtgtgggccacaagtgtgccagagctgtcagaccttccggtgtgcaagctttgatcgttagaagacaagccttgaaggaaaaaacctccatttaggtgacaaaaccagatttagaataacctggcttacttgggatatctgcttagtgatctgtgcctttaagtactagagacttaggacatctgagccagaggagacctatgaggccatctgttcccatagctccattgtacagatgaagaaaccatgacccagagaggagtgtgacttgcctccagtcacccagctccaaagagcagagtaaaaaccagaacccaagccttctgactgtggaccagtattttcatctcagttagtaatcagatgttctgctctgaaaggcctgatagcttaaagattggaaccagccctatgctatatattttttcccctccttctaccaagtagttaaaatgagtatctttttttaagagactgggtgtctctctgtcacctaggctggagtggcgtgaccatggctcactgcagccacaaactcctgggctcaagggatcttcctgcctcagcctcccaagtagctggcattacaggtgtgagccaccacacctggcccagaatgagtgttcttaattgcttcatattaggaagcttttgcacttggctcaaagaatcagaaaaatagggcctctttgtggatggtataagtgtggcaataggccaacactgaccacctcccatagtccagacactttacatacattatcccctttaagtctcacaagggcactgggggcatttcatccccattctatgtatgaggctcagaggaggtcagtaacttgaccaagaccacatggagccagtactgggactgtctaatttcaagtccatgttctttctacccagcctcttagacccttgctagctggaagccagagagacctgggttaagttcctacttccccatttatttacgaggaatctcaccttcctaatgctagggcgaggcctggggcacagtaggcacttaagaaatagttgttgaactgcagcttggacaggtctgccctgtcaagcctcaatttccctgggtggttatagcatttcaacacattgtgcaagctaaagcagttcatgtatgtaaaagtgtgaggcagataagatcactgttatttactgagcacttactatgtgcttgatattctcagcattttatgtggattttcccatttaattgccataaaagcagtaaacactgagatggatacttttgtgattgtttccattgtacagatgagctggggcaggtaaagcataagcaacttgcccaaggtcacacacccagtgagtggaggcgccaggtctgaatctcaggcagtgactacagagcttgcctccttccccacagcatggtcctccctcagtgctgccgcccactaaacccaagtctagttgagggtggggaagagagacacatgcaactgaggacacagaaagggaaagcaacttgtttaaggtcccccagcaagtgagaggtcataaaacccagcaaagacttgctgtctaaagtaacacggggccttggtctttcaaaagtattccctctctaatggagaaggacacgatgtcctggaaagtactcctaaactagagacggtcaccaggaatcccgactgcctggtggactccatggctttcctctttggtccttgcctctcactcatttggaatcattccttctctggattgcagagcagaaaccaatataaatttgacccagtctctagaaatgtttacctggctaaaaatatgccagctttgtcatatttttagccacatttagatttgaagtatatgaattgcccacacccatgtattaggcatgaactgttggtacattttgtaacaggacctgctagttttccattccaaagaactggaattcagtcagaaatttgtcatttgcaaataccaactctcgctacattccattgctgtttttaagagtgtctcgtcacctggattgtgaggaagcaggccatgggcgaggccaggctggctgggctgccttggtgcattccccaggtctggtggcttctaatcgacctctgcctggctctgccgaggccctcgccgttctgcggtgtgttgcctttggattagcataagggcagacagggtgcttattttagaactggaaggagaggagatatatcaataaaagaaatgggaaaggaaaaatcccttcagtggtttaaaaatatctcttccttaacaggctagattatttcatttcttaaaaacaactagtaattttctcctctgaaacagcattggaaagagaggcgtgtcagactaaaaaaggaggggctgaaatggtggcctgtagttttcactcccctgtcctgttcctataggataggttattttccccagtctcccaaagccttcctattgactctggaaccttagaactatatcacaaagactctgttttcttaccccttcattttgaagatgaggatgccacgcctcagggcctttgcacttgctgctcttcctgcatggaatgtcttccccagataccaacagcactcactccctcagctccagttctttgctttgatgttaccttatcagagaggtgcctttcctgagtttagaactgactgtgagctgcccacagtagaatgtgggaatcagggttgccaacaggcacgattccactttgttttcagattttcttttttatttttcttttctgcccactttttgtgatctaaacacttgctaacaaaagtatggtctgtggcctggttgtaatggcatcacctggaagcttgttagaaatgcagaatcccaggccttgccccagacctgctgaatcaacatctgtattttaataagatcccggatgacatatacagaaatgaaagtttaagaaacagaagagcatttatgccctcaaccccttcagaagaagaatctaagagaaaccccatcccacaaagtactgtcgccacctctgtctggaggcacaggcccaactgcctcaaataaccccctatggttgaagatgggagggatggatggagtcaccctagaagaggacctcataagacagacttccgaaatccatagctactctgtttcttacatctctcatgttgcttagggtaattcacctgtacactgggctttgtagctaatgtttggtcaccatgaccagagactgttatctacttggtagctgcagagggaagggaaacccagtcttcaacctgggagtgcagcagtaattagagggccttgactccccactctgccaggtgtgcctgggctggttgagatagcacctttcaggagctggaggtagttccatccagcccgtctcacaaatggctgtgaatgcctctctagatccttcagcaaagacaggtcagctattcccacagtctgaatagaaaccaactcccacagtcctttgctgtttggaaatcttccagttcttgagtcccccaaatcacattgcatcattctagcatgtggttatgtaggaggcaggatgcttcccagggcaccagtgggaggggctcactccctctccattgccttgtctaatgctcagggaagccctctcaatgggcaggtgctgtgcaaatctaatctgcctgtggaggcatttctttcaatcaccctgcaattgtgcattgatttggggaaagcccattgataagagtagagcagaataactgagctcctgaattaggctgcttgatgaaattattgtctaatgctgatgttggagcctttttcccttgttctgtgtaaatcagggctattttaaagctgtcacatgatcactgatgccatagaaactgcctgaccttgtgcacacctgtgtctcagtcaggcatggaccaccacaggtggaggaagaggacttagtgacagaggtgtagcttcactccagagtctgcacgaggaaggaaggtagtagaggatgctgtggagcactttttggtttctcctagctttgtccagctctcctagctttgtctcatttaaccccattgaaaccacctggaggaatgactactccagccactctggagtccagacctggtcctgagcagggacagggaagctgtcctatgactgagagatgatgttttggcaccaagaaggtttctgtgtgtgtgcatgcatgtgtttgtgtttgcatgcacatgcgtcgagatgctccttgagaggttgtagaaagtccactttggccactggcatcaccatagcatatgagacagtatggtgagcctgaaagagcactgttcttagagtcaaaaacattaagttctctttctagaccctcatttagcaagcttcatgactctgggcgcatattcagtggttcttcaccagccgtgtgtagaattgtccaaataatccaccagccctgatgtctcccatagattcaggcctggagtggcactttggcatctgtatttcttagggctctgcaggagattctgatgcacaccctggggtgagatctgaatttgagactagccccctcagagaagtcaggatagtgaagtggaaaagagcgagtggtcattgccacacagaccagggtttggatttcagctctgtccacgtacagcagcatggtcttaggcaagctgctaaaccctgcctctgcttcctcatctgcaccacaggcaccatagcaatgacctcacagggctgctctcagcactaaatgcgatcatgtggatgaggcatgtggcaaatgcctggcatgtgagtacaccgtaaatgttacatcttgggtgtgagtatgtctgtgtgtgttttctgctgtactgttatatatggatagaatcctctcaagaaaagtccaaggcagaactcaatcaagaaatgagatggcagtgctctattatattagtgtaatttggtaataaggaaaccaattaattcattctttgttattaatagcaaggaacgtatgcagagaaaggtcctatggggcaagagagagatgccaagagtgcaccccttccttcatgacagtagttcttaaacttcaatgtactcaggattacccagggagcttgttaagtgtgcagaatcatgggccagagcatcagagagtctgattttgcagatctggggtgaggtccaagaattcatatctttgaaaaatatgaccaagtgagtgtgcataagatggtctgtagccttcactctgacaaagactggtctagattagaagatgaaattggaagactgagggaaggagggaactgggtgacttggagcaagcaggaatgggatcctagaagatgggagaggagctgaggtttgaatgcatgcaagatcccgagaaaacagggaagcatactttggatttggtctgatgaacagacggtggagagctctggtggacaggaagctctggctcttctccctgctgccattggcaggagatgccaggttgggtaggcatcacactgggaatgtcagccactaggaagggtttactgagaatcctggtgaaatataatgaacccaaggcatgtgtctctttgtcctctctttaaggcccaagatggctggctttaagttgcctaactgtgcccatagagttgagcttctttttatctatttccttattcagaaatgagggcttgaagcagcctgcagtggtagacctggaagtataaagtagatttgtgatgctcagggcaccagagtgggctagcagaaagggcaccagagatgataggagatgttgagtgccatttctccttattaggggctgtgttggctgagaggggccacagctgaatctcaggtctgcaggggacccatgttccatgataaagtctgaaccaagacatccctgtaacagtggcctttggatctgcaacctataggagagcaaattttggggggtcttcactggatcaggaagagctacaaataagaatggagaggggaaggggttgtgtactcagcacttactatgtgccaggctccacattccatgcttacatgatgtttgtaatctagcctccaccttaggaggtagatagctctagttttacagatgaagaaagagatgcccagagaggtgaagcaactcacagctttacacagccaggatttggtaaagcctgggcttgaacttgcatctatctggtttctgtcatgaatcttccacagttctatggtgaatgtgttggggaccttgattcttggtcctcaggtgcaagtgcctcggaagcccagttcccctcggcagggtcgggggttcagtgtgggcagagtgccctggagtcctgtgacttgtggggcatttctgtgccctctgtcaacaatccagccttcagtaacgttgtgctgctgccggctgctttcaccacatccagaccccccacccacacaggcgaaggttttggccaagggcaccctggagggggaggaaaaagtgccttccagaggggcttgttgcaaagcccctgaatggacccattgaggctccagggcaggatgacaatgggcctgttggggccctcggtctgctgaggtgacagggctggggccgggcaggcagtgcagtgctggctcagaggccagacgctgacttccagggctgggagccagcgcttctgacgtgctccgaaatgccagctttgcttaatggggagcagctggggtgggctccgcataactccctatgccaggaaggcagcgtgaacccagttcctcaggctacagccgctcttttcctcctcccggcctggcactgctcccccttcctgagccaggccttgctcaccggacaccaggatcatagtcagctccttctagtgtccccttggtcctcaggggcattcttttcagcctgattggataaataacaccccttccccaatagtctagcctgcctacaggtgcagctgccagctaacatgcagcatgcccagtgaaatttgaattttaaataaatgatgaaaaaattttaattatatttaaatatgtaataaatgacaaagcctgaaccaagatatgagttcattttgtgggtcatgggacacacttaaaccaaaaaattatttgctgtttatctgaaattcagatttaactgggcatcctctatttttatgtgctagatctgatgaccctacccaaggcagccatgatggatacccatgtggggttactaggacttagttaggttttcctttatgccaccaaggtgggggatagggagaaggaggcctctctgtgcccaccctccacctcccatttcctgtacataaaatgctggatgccacacttagtaggtcttactcacaggcaagcattgcccccagtgttacccacaccaccctcccttctaggagctgcagctttctccctggctcccacagtgggaagggaagctttgggatacaattgcagttggtgactatttactgagcacctgcctatcacactgggctgaaccctggcaatttaatgagaatgagacagatgtaggctttgctctcaaaagagcttacaggctagtaggggagagaggcatttgaacaaaagagcaactataattcagtgaaccataaacactgtgggtaggtggcaggggttgttggggggatagttattgagggaggtatctcagaaattccaggagagcatctcactcgcacctgtaggaccaggatagaggtcttagagtcaggagatttgagatgaaatcctgggccacgtcattgagttgagtagctatgtgggcatgggccgatcatttaacctcttgagccttgattttccttatctagaaagtgggaacaattttccttgctttagggaccaatgtgagtttccaagtaaaatgattaatgtgaacatgtattgctaactgcagggtcctagatcaaacaaatgtgtgtgtttgtgtgtatgtgtgaagtcagaggtaggagttgaaggatagggaaaatacagaggggttaggaatgcttgggccccatccctgctctgtggcttgtacagtattttgctgtttgcaaaggataatgattaagagtatgggctgggaggctgaggtgagtagatcacctgaggtcaggagtttgagaccagcctggccaacatggcaaaaccccatctctactaaacaaaaatacaaaaattaaccaggcatggtggcgcgcacttgtagtcagtctccctgctactcgggaggctgaggcaggagaatcgcttgaacccaggaggcggaggttgcagtgagacgaaatcatgccactgtactccagcctgggtgacagagtgagactccgtctcaagaaaaaaaaaaaaagagtatgggctggaaattcaaacaggcctgggtttcagcgccatctctactgtgtgacctcaagtaagtacctaatctctttgtgccttagttttctcccctgtaaaatggagcctcacaggcatggttaaaaggatgaaaagtagaccattcatataaagtgcttagcatggagtctgtcacatagcaagtgcccagaagtgggcagctattaagagggtcttagttgagtagcataacaaccttgtgaggtagaaattatcaggtggagaatgaagttcagagaggttaggtaaccagcccaaggaggcatagccagagaggcgcctctgggagaatatacccctggcttcttaggaggcctttggtcacccagccttcaaggaactctgcttctagcttttggttggacaattccctggggactagctggactctgggattccttgcccagttatggtctggttcagatacctgggtgtttcctggagatctcagcatgcctgtgtgtgccaggcctaccctgcccagcctctgcagggtcagggagaaagagcatcctttaggaatctgatgacttacgtgcctcacaccaactattcttcctttgctggatttgaagtctgagatatgggcctcatttttattatcttattcctttgtgttaatcaatgcctgcacaattatgcagttggcatggatgctagttttattgtcttgaacacaaaagcagctttgaaaatgtggtatttctagggagcggctgggggtgagcctctcactggagaaggcaaactttagccaatcatttccccctccaatgggaacagaagcaggtggattaaactgctccattaggcgatcttttgtttctaatagaataatcatcaacaacccttgatggttgaaggtcagggaagggagctagacctggctgagcatttgctgtgtgctcagctctgtgttggagcttctttcacatcaagttcagttgtctctatcactctgtgtttatgtcttagacccatttttcaaatgagtaagatgagatagagaagttgactgatttgatctaggtcacatggctggtaaatgatagctccaggttttgagctcaagtctgttcagttctggagtccataccttactatcacccatgtgcctaggtctatgtgctttacgggagaccgaaacagtggaaggcatgtgcttgccttcaggttctgctaagaacccaagatgcttcacttaccgcacaacgggttttaaggcacctgcaccgttagttcctgacttgataacatgggactgagacttccaggggaaatggggtaggagctggtttctgatttcacatttacttaaaggagagaaaggatttagatatatggggagaggaaagagggtttttcaaggacagaaagctatcatgggattccaagtaggggaaggcgggctgaaaatagtgtataagagattcatatcaggacatggaaaaggatgaagactggaggcctacctggagactgttggtaatcctggtactgctactgatgatggtaatgggaggctgatggtggtagttgtgatagtgatagtgatggtgatggttaacgtgtattgaatgcttaatatttgccagatactagtctaagaattttacaagcatgaacttgtttaatgctcacaacaatcttataggaaaggtactgtaattagccccatttttagttgaggaaatggaggcatagagaggcataagggtctgaaatagtggtggactttgaggctggagaataacaagcagatgtaagagccattgaaggaagaactagggcagaatctggtgaccatgtcgagaaagggataaaggaataggagagtctacaatgaattcaaggtaacctattgatcttttataggagccaacttcctggtggtagttattggtgaagttatgacctgactaggaaagacaagctttcaatttactaaatgcctttattaaaatggaaatgtgatatttgagaggatgaatatgatgacccattgccagacatagacatcttaacatgagtgaggtcatcagcttcagtgcaaggggaattgcttaagtgaagggacactggatgggttagttttgagaaggcctgtgccagccaattccttccttcagggtgtgctatcctaaacataaccacccagggtctcttttcctacaaccgcttccccttccttcctattcaccctcaatctgatgtaaagcagttcatgctcaagcattcgttgccaacactggattaagatctccctccttccaggtcatacattggcattttaacagagacttttagaaacttggctaatgaaggtggggatgtgagtgatcctggggttaggaagggatgggaaaagttcatgcatccctcccctaactcccaacagacatacaatggaaagggctggggtctcaacttaggcttcacaccagcagtgcctggactccaagtttctagacccagattcccaaaaaagtcatgaaacacattctcttagccaagtatgccatggagggctgggtcaagcctatgagcctccactcaggctggcagtgaaaagcagccctgggccctccagcccacctaggtagcatgtagttattacaagcatggactctccagacagccaagctagagttggagccaagcctcagatttgtttgctgtgtgaccttaaacaagtcatttcatttctcgactcttagttttctcatttgtaaatgaggataatagtgttgagaggagtaaatcagagaaggtctgtaaggtgctgagcccaggacatatcacatagtaggtactcactaaatataagctgcagttgtcgtgccaggcccactgtgaacaactccagaagacataaagcttctccatgggctttgggtgaagcctgggaccaggcagctaggtgttcccagttgcaggatggcagtgagcttagcacgggcccctgctcacgctccctggctctctctgccagaaaaatgggtggtactagagagtctgcatttccctgcgagcagctttcttcccttggcatcctaggcagggcctttgtacaattccttttcagcccccaaagatctatatcagaggtaatagtagttccaactgatacttacagagcacctactatgttccaggcactggattcattaatcctcccaatctttctgtgaaatcagcactattattcaccctgttttacatgggatgaaatgcaggcacagcaaggccttgcttagagcaagtcacttgctaagaattatatagctaaatcagagccacaacttgaactccattctgaaccaaggagtttgaaaccattcctcctgcatgatgcatgaaattttaataacctgccgacagcccaggaggtttgcagtttctctgagcccaagggaccagagccatctggtgggtgctttttcaagggagctggtgtgactgtttcagggtaaaatgcagagaaatagcatcactttttttttccccgtggtaaaaataacatgcaaggatgggaagaacaaatggaggttgggaggctgacattgcggggaggaaggagctagaatgctgggggctgtctacctggtgccatgtgctgccatctgcccagtatgggggcaacatcagcctgacctgccagcacctgcctggctaccagtatcagctttcaggaataaaaagatctttttcaaaaagcctttgttccccagggaagctcaaggggcagagtgaggtccgtggagggttgtgacagttcaaaacatgctgtccatttatagtatgcagcagtgaccctatatctcaccctctctatagcaactagctccagacacaaactgggcatggcttttgatcatgaagcatgtttttacaaacaaaaaaatactgaaagtagtatgtgaggctgagattatgttaatttatgcagtttccactgctgctaggattaaaaatagctttctttcaagaaaactagaactacgcactgtcagtatgccttctaggccctcttgttgggctccaggactggtgggccagacacaggacatggattatgagatcctccttggcagtcccaggttctggagctttgctgaagtggaagataaagacactttatcttccagtggtaaggactcttacaaagtctttactgcatgtttcataaaactggatatgctgagctctaatgaaagctgttgtcagcattaaatacccagggaaaggcatggaggcctttaaaaaactgccacaatgctcctgcactgaagtgctcacattttgctccatatgtgagagggaggggaatttggccagtgtcatccacctcataaaaggcaaacccaggatttaaactcaggtctggtgcctccaaagcccaggaactcatgacatctcttcccccaactctgctgttctacatgttgattatggctacctgtggtgctcattttaatcagatttcatcaatataaacattagtggtggggtcttcctttagagttagtatagccacaaccacctcccctaggttatgcaggacacctggcaaaccttttctgaggggcccctaccaggggaaaaaaaaacttattgccaaacattaatatgccagccccattttggcgggccggtctcacacaatctcatgaaagaactgtagtgccagccaggaggggcagtcctcttgctctcctagaattggctgctagccgtagagcccaaggcaacaccactggggtaattcctgaagatccttgggacatctggttgacaccataagtggacagaagtttagagactgctctgaagggacagctgaggacagggactcctgtggttctgggtcagagcaaggaacagcctggtcaatcccagccactggaaagagacttagagaatttcaaagagagcatggaaaccagaaaatatgagtgaaagggaagggagtgaatctacatattatacaccgtctatataccagttacagtgctatgcatcgtggggagttacagggtgcacaagaaggacagaacccatactttcacggatcttacagcctggttgggagaataggcattataattacatcatggcagggagaagggatggggaagaggagatggggaaagggcccagctgtcaaatagataattccaaggcagagtaatatggtagaaggtggtataacctggcaattgcaatcacagacttgggatcaaagagactggatccaagaaccatccttgctcctttccagttccatgtccctatgcaaggcatttatttatactctgagctcagtttcctcatctgaaaaatggagataagagttcttacccgacagggtgcttgagagggttaagtgaaatagtgcatggaaggcacttagcaggaggtctgacatgcatatcgtgcccagtgaatggtggctattactagttattatctgatttctgagacctgagcagatccaacgcagctgatccgagtaggggagctgagataagtaggtgctctgacagcccaagccatggctgatggtgaaaccactgacaatctgacagcaaaggaagaggggaccaaaaaatctactgtctcagcagctcttagagcaattagtggtggttatgatgtgaatttctgtttgatgtcctcgtctttttgagaagatgtgagtgtataatgtacaacttcatgaatgaaaaggtaaaataaaattttgagtgctttgaacaggaagattatctggaaaattcactgactggggaggcctccttccctgacatggcatgcagaaagagctgtcttgggcttatggagaggttgacacctccagaaccatctgctctgcagagagttccctcagggggccagtgacatgccccagagtcgggtccctttcctccctcagtgccagctatgctttccctgccacatggcaacagcccaggcagggcaggggcctctagacacatgtctgctgaagacccagcaggagcctgtcagccttgcccaggccggatttccagttctgtagatgtagatcataaatgtgggtgacagatgtgggagagacacatccaggagatgaaaagatatctccatctgcttggttctggagaaaatacggagaccataagtggatggtggcttttcctaatggggaactgtggctgagttttcctggggcgaagcagtatttacaaccaacccagaccccgcccccagtatcctgacaccaggtttggctgatcaagttggtagagggggcttgtttgctaggggatactggggagaatggttcctggccattgtgaggagagctcagtctctgtcctgtaaaggaaaccacacaggttttagtgtttgggctttgtgaaggctctttaaaggtgttttaatgacagcagagatgaaaggtaaggcttctgctgctctgatgtgtgactgtctgtccaagctgcccacagcagtgcagagttgtgtgctggagctcagaacctcccttggagctcagtaaattagcttctgtcccctggttcacgtattggtacctgctgggagaagaggcagaagctggagaaaacacacaactaatattagatggaaaaatggaattagaaacatatacaaatcactagcctgggcaacatggtgaaacgccatcactacaaaaaatacaaaaattagctgggcatagtggcacacgcctgtggtctcagctactcagcaggctaaggtgggaggatcacttgagcccagggagtttgaggctgcagtgaaccacgattgtgccactgggcttcagtctgggtgacagagtgagaccctctgtcaaaaaaagaaaagaagatacatagacaactcttacacacttcccttgtaatcctcccaacttggtcagtaaaatttaaaatcatttattgaacattcatatatactagattctgtgttactctcttcatattctcagttaatcatcgtagcaacctagagcattctcattttatttgcattttaatgatgagaaatgagtaaagagagggctagatgcccaaggtcacacaggaaatgacagagcagagatgtaaactcaggtctgtcccccttaattgttacttcagaggtcacgctggggaccctgaatccccctgttttcagggtcagtagcgaatttttaagctgaggggtgtagctgatggccctcagactgaatcaggtctgtggagacatttgcttatctggcacattggtttagaaaatttttaaaaatgattttagagagtgttctctgttagccacagtatccaccatgctcatatgtcttatacctggtcagcttcttggcccctatgggaatttgagtttataatccctagctaaacctctcttttgctggagtcagtgatggaaacagaggagactggtagtgtcctaaggaaaaaatgctttattttgccctctgaagaaggaagcagcggctggcagctccagacttcggccaagctggatggaggaacttctaagagggccctggtgtttgcttttaggctcagaacccagctttcatgaatttaaatttcacagtagatctgaagaggacagtggaggggaaactgtattatcctctccttggagagggaaaggaaggttctccctgtttattcgtactccgagcaggctccccctggagggcagccactgggagcttgatggggaatcctttgtactgcgcactttggaggcatctactagaaacaaagtaccctgtgacatgctggaagggatctccggacagtaaaacatacaaggaacagacccagggcaaactgtacttattcatgatgggccctgaagtgtgaaggggtttattcaaaagaagtaggtaggtggcattccaggtaaaggggacattgtgggcaaagacatggggatgaaacgtgtgctgtgtcaactcagggttaaatggattaagggcagtgcaagatgtgctttgttaaacagatgcttgaaggcagcatgctccttaagagtcatcaccactccctaatctcaagtacccagggacacaaacactgccgaaggccacagggacctctgcctaggaaaacagagacctttgttcacgtgtttatctgctgaccttctctccactattatcctgtgaccctgccacatccccctctctgagaaacacccaagaatgatcaataaatactaaaaaaaaataaaaataaaaataaaaagaacacaggagacatattcaggcaaggagatttactgatattttgcagaggggaagagtacaatgggggaattgaactagaaacaatacttcctttggtagcccagtcagcaataatagcaaacatttattgagtgcttactgtatctcgggcatgttatcagcatgtgacatatattgttttctccagtcctcacaaaaagcctataaggtagacactattactattgttatcatctacatttgcagatgaggaagctgatgcaaagagctcacagccacattccagatcacccagctagtaacccaggtattatggtcttagagcccaagagcccacactcctaacctcttcttcctgctgcttccaatagcagccaacagtctgggtgacttatcagtagaagggatgtgagattgtagcaagagatcaagtgagaggagtttagatcctgcaatggcaccattttcaaagatgggaatgtaaccttttctgacatcaaggctgtctcctaaatggccttagcctcccccttacagattttattttttaatttttaattgtataaatttaagatgtacaatctgttttcatatacttgtacatagtgaaatgattactacagggaagcaatttcatatgtccatcatctcatataagtatctttatgtgtgtggtaagagtacttaaaacctactctcttagaaaattttcagcatacaatataatattaactatagtcctcatgctgcactttagatctctagatttatttatcccacagaacttcaactttgtcccctttgttctatatctccccattctttcccccacttccctcccccacttcaggtaacaactgttctactctctgcttctatgagcctggctttctttctttctttcttttttttttttttttaaagattccacatataagagagatcatgcggtatttttctttctgtgtctgggcttatttcacttagcctaatgtcctgcagtttcatccatgttgatgcaaatggcatgatttccttctttgtaaaagttgaataatatttcattgtgtatgtatgtatcatgtgtgtgtgtgtatatatatatatatatatatatatatatatatatatatatcacaatttatttatccatttatccgttgatagacatttatgttgtttccatatcttagcaattgcaaataatgctgcaacaaataggggagtgcagatatgtctatgaggtgctgacttcattccctttgggtatatacccagaagggggattgctgggtcatacggcatttccacttttaatttcttgaggaacctccatgctatttttcataatgcctgctttcccaaaaacagtgttcaggggttaccttttctccacatccttgccaacacttgttatcttttgactttttttggatgatagccatcctaacaggtgtaaggtaatatctgcatctcactatagttttcatttgccttttcctgatgattagtgatgttgagcaccttgtcatacacctgttctccccttcacccctcctgagccccttatactccagcccaaccaaacatttttggaagaccatggactcagcagtcatcgggacttggggtcaaatactggctctaccacttcctacctcctgtaactttgggctagttacttaacctctttcagtctcaatttcctcatctgtaaaacaagggtgataaaagtacttgcctcatacattctttgtgagaattaaagaagacaagtgcaaggcacttaacacagagtctggcacatagttagtgcccaataaacagctactttaaggccagaataaatttcacacatggtcatcatctagctctgggattggcaagggtgtgggtgtggtttgcaaggaagactcatggactgcctgctacccactacgtgaggcgctccaggtaagagctggtggctggcagttcatgcctccttgttctgcttggtgcctatgtggatgaggcactggttccagggaggttacagggctggttcccctgtaccagggcacagcctggtatcagctctgcccatctctagatagtgggagcaggaatccttcagtcctgatgcacagatgggcaggaaatctaaaagccacctctgcccttgtccaagccagtccacatgtggattagaagctgcagctctgcactgctgtacctggaaggcacagacaggcagacaggcccatgttcctgtccactttggtggctgtcctggcaagctgtggctactattgccacctggtggcgtttcacagcaacacatgcatggagacttctgtagtgtcttattaaagatgtcaaagtttgtagcatcctgggaattgaaggtccacttctacctgctcacagtgcggaaggcaaaaccaagattagagaaggaagaacagtggggtttaggagaaagagcactgtgagagttgtgtagccttggttcaaattctactccccctatttgggattttggacaaatgacaacctatgtgaacttgtttcttatctaaaatgtggtggagatcctcaacatttactcataaggccactgtgaggctcctatgaagggctttataaactgcaaaggaccctacaggtggagaggtggtggttatagctgttgcagctccaaagtgaggccagtacttctgaacttgggagtcaggggtctggcctagcataaccaaccactacccaagcctagcaacaagacagatggcagaaggaatggatatgagctactccctctttgctggcccaggatatctccagggtgggtgaagcactggggtcttccacccgtgctgtgagttcctggtgctttctccctcctgggtcttgcctgcagtctgctcacacaagtgtagcttcaggtgggaatgcctagtgcctgcagttgtcagttctaggcatgaggagcttgtgtctgggtttccccaaaggacaacattctgggtctcaatgaaggacaagatgcagaattccaaggcgaggccacaaaaaagtgctgggcttagcctagagctacctctccagccccaggaatgtgacggtatctggacctggacacaaagcattagctcatcccttctgatgatagacaaagagcctagtgctcagagttgggcagtcatcccggcagcttctcactgtcctgcccaggcagctgtctggactggtccagcccaaagagcctggagtgtctacttaccccactggcatggaaggtttgggtcaggccagggtcatcccaatcctcaggccctaatgctaagcccatctcacaggtactcggaggaggagtcctatttgggttgtagtatgcttcccctccactggcctcagatacagttggtttactgagcacctaatatgtgttagataaggtacaagatgttttcacagagattatctcatctcttcctcaaagaagccctggaagtgtggtgtgattgttcccatattacagatgaagaaactgaggcttacagaggttcagtcacttagtgaagtgggagcttggttttaaacccatacttctgcctctagggcttgcctttgtgtagtttaagagtgaaagactttccagaaagagacctggagtgaaggcctatcctagggatgagttgcaggccttcactgtgcagagtagaggatgccaatggcacactttgccagagacccattgaaacactccccagtgccagctgttggctgtcactccttccatctccctgtcctaaatacctccagaaggtttagttctgacaccactcatgtggggcccatttagagagacagtgagttagggaacatggctgaggatggaggaaggagcaccactaattgtggtaaacccataattagttctctgcttatggcttcaatcagtacttttaatttaaaaggtaatatctgtggattttttttttaaagatttgtgacatgggtataaaaggaatagaaaacactcatgttttctccaaccaacctcaccccactgtctcagaaatcacctctatgaacagtttcttgtgcatcattccagaaaatttgtacaaaaacaagtatattcaaatacatctatcctttctttactccagttggaatttcaccatcctcaccatcctacagaggtcttctttcatgcatcatcatctcttaggcatctcctgacatagatgtcaaatgccttctcttaactctgcactgtagactattatatggccattgtcctcctggtaggcattttggttatcctgattttttgccgtcatgaacaatgtgctgattacacctctatttttgcacagtttcccatataggactgtaagataggtggactcctgaaagcataattattggatcaaagtacatgctttttagattttactaaatattccctatcgctctctagcagggttgtactgtcaccagcactaggagtagaaatgatctccacatggaagatgagtccagtagtcatgtgggacagttgctgagaagacatgatttcagaggcacccagaaactgctcatgatcctgtccccctcaggaatctcccctttccgcctgtcatggtgtctggaattctcattcattccttgacctgtggcattgtctccagaaagctcaggtgtttattttatgactgcatttgcaaaagacaaatataatccaggctaaattgtatccatttcatccttctggtttaaaaaacaaattacaacatttccttgggcccctaaaactatcttggctcctaagcattgtgcctactctgcctaatgggtaagttggccctcgattttgtccccagagtagccctccacacacctgcttccctacatgttgtcaccattcctgcccctggcttttgacactggaaaggtgtaaaatacaatctttcttgggggtagccggctatcacagaaagcggtggtccccagcctttctggcaccaaagacccagttttgtggaagacaatttttccatggacagagatgcaggatatggtttcgggatgaaacttttgcacctcagatcatcaggcattagattctcataaggagtgtgcaacctagatccctcgcatgtgcagttcacaatcgggttcacgctcctgtgagaatctaatgccaccactgatctgacaggcagagctcaggtggtaatgctcactcgcccaccactcacctcctgctgtgcagcccagttcctaacaggccatacaatggtacttgtccatggttcaaggtctggggacccctgacataaagcactgggcaacatttggatgggatcagggctgaccgtatttactaacaactgcagaatcctgcagtttccaaagcatttttatcaacatgattttcttaaaatattatgcccattttacagattagggaaatgaagacactaaaacagagaagagaagtgatttgtccaaaacacaaagctagtaagaaatagaatcatagggtcaggtcaaatgcagcctcggcccacttcacagcttccagcacagttaggttctgctggatctcatgatatatctttgtccctgaacatctcatatgtgtggcattgcagaagacatgctgacagtgtcacatcctgacaggtgcacaagtggagctcaacatatttgggtggcatatggaagctaattgcagccgtggttcccaaatctctccccaagtaactgacttcagtatgcgtttgtatgtttttttttaactagagtaaatttgattgtcacacatgcctccaatcttattttaatgtaagtagagcatgattggaaattcagaattagactgcccagcattaattacctctcaactacactttttatttatggagcatgtttactgtcattaatgaggagaacgctagaagggcatggaaggaggattgatcaaaagaaggtggattgaataagtagttatggatagggcaatttgaaatggatttattcctttttaatttaaattgtatctgatttctgcattctgattcttctaacccctttgccacatgcccccatgttctctttttgaatcttgctctcattcacctcgtattgccccatccacagtgttaataagataatgtccaggatgccccctaaaattggtactcctgattgcaaggggctgcaagattctctcatcatgtctgtcccggcttaaaaaaaaacatgaagattatcactgtctaccttttattgaacactctttttttaattttattattactatactttaaattttagggtacatgtgcacaacgtgcaggttagttacatatgtatacatgtgccatgttggtgtgctgcacccattaactcatcatttagcattaggtatatctcctaatatctatccctctcccctccccccaccccacaacagtccccagtgtgtgacattccccttcctgtgtccatgtgttctcattgttcaattcccacctatgagtgagaacatgcggtatttggttttttgtccttgcgatagtttgctgagaatgatggtttccagtttcatccatgtccctataaaggacacgaactcatcattttttatggctgcatagtattccatggtgtatatgtgccacattttcttaatccagtctatcattgttggacatttatgttgtgaacactcattatgtctcaagtactttctcaccactcattattttacctcctaataacactattaggaggagtaggaataattatacctaatatatagctgtgaaacctgaggcttagagaggttgaatcagtagtttgaagtcacacagcagatataggagtcaaattcattacacattgtcaacactgactatgccattctcacacaggacagtagtcagaaagggctgaatgaagcatatcgccaagcaaccaggagtggaagggatctaggactagggctgagtctcaatgcttggaccactcagcattcaatttgcccttgcaggggaggcaaatctgcttttgtcccattcctggcgtcctctgctccccctgactatctttaggcagtagcattgatctggtttcaagctattttggtttttcaaactaaaaactaagctgagttgggctacactatttacttaatgctttcccttggcagttatttcccttccaggaaagagctactgtgtgtcattttctctcctgacagtgatcccttctggaaaccaggagcttccggcccaggtagagacctggaagacttggccaggctgctaggcctctgtctgctgcccctggggagcctgctaaccaagtagggagatggtttgcagcccaggaaaccctgagcacatgggcagttgagcatggcattagtgggatatgctgggcatgtagtgagaccttgtccaggctttgtggggaaggctctgatgtcaaacgaggcagctctgaggctgtgggcagtgctgaccagtggactggtggaggcagagagattggatttccttcaaagcaagtcacagtcaattctcccagcttgttcagaggcccttatagatgcctgcatgtgccctgggattttcacatcccaggagacagtgaggcagacctgtttacccacattttacaaattaggtaaccaaggattgcagagttcaattaagccactcttatttatcaagcatcttactgtgatgtgaaggcacaagagacctggaccccacctccaaggagtatgagagagggaaaaagaaatgtagccaggccactggaagtgtcacaatctaggctggatttgaatcctccctctgctacttctcactatttaatcttttttgaatctcattttccttacctgtaaactagttataatacatacaccacaaactcctcagggacaagggccaggcttgtcttgttctccacctaatccctggcgcctagcatggtgcctggcacagagtaaggaatgcatatctgttaaatgaatgagtagacattgtcatgagtattaaatgtaatgatgtgggtaaaatgcttacttaaaggttcatgggaagcactcaatgaatggtagtgttaatactctgttaggaacggggcagggaaggtgcaggcacctcacttcacagagaggtgcagaccaaagagaaacaggcttgcaagacaatgagcatatccctcagccaggtttccaaaacagatgatgctgctgaaaggtaaagatgtgagtgaccatgattaaagatattgacaggcagagatagggaagaacttgcccaaaccacaaggctggtgactggcaaaagccagggttaaaacttggagcttctaactctcagtttgtgttgtttctgggccattcagaggtcttcttgtaccctttaaagttttaccagcagattgtttaagcatcctctgtatgaagctcttagaatttcaaatggactcttatttttagaagcagcatcccactgagcatttgacagtgatcgattcatttcccagtttgttttttaataagcttaaaggttactgttgataactgtttatagacagttaatgtggtacttgcagttcctgatttcttaggcctgggactcactgcgccttcaagatgctgaaaccaagcaaggtgtgaggagtaggtgggggcatctccctcccagattttcctcacctcttcaaggctgtcattcacaactccagtcactggctgctgcaacgttgttcccaatttgactaaaatgtcgttattttttatgatgactttattctttccatcataagctggatgattaggagctagaggcagccagtaattaagctcacctgtcagagtttagattcagtcagaatgaaacacatcctttaacttcccctttcatttccctggatgtcaagacgtctgaattaagctccttatgggaacaatatctgacccaaaaatgttaggacagggattaccgagatggaaattcggttacgttacctacttgtcatgacttagaagggctgtgaattctcaggctgcttgagaaaactactcatttgtgaggagaattgagttccaaaccataatagctagtggaagcaatttctgggatcacagcattcagacttgatattcatttgtccccttgagaaggaattcaggctagagactttcacgaataaaagtgcaaagtccacaaaatctcctggtgccgtttgtcatctgcggagaggcctgcctcacgtctatggctttgagggagcagagcattcagatactttgtttctgctggtgggccatttgagccaatggctagatgaagctttgttcttgactcttgaaaattatactctgatgtacttcaaagggattctaatgaggacattggaagcacaaagaattcagctttgcaaagtcagttctcaattccataaagttcggcattacttgatttctctaacgaacctcttcgctctcccttgcctgtgtctgggtgaggattgtcttagaggacattgatcattttcaccttcattttccatttttgcttctggtatgctcatctcacccccagttttatcaacagctcctctgcattcttttctctcttcacatgcaaggtttggcagaaatggccttcgtttctaaaatgttgattaaagacattttctgaaaatctatcagtcccaaaccttctcacttatacacatctttttctctcacaactgccatgtgtctcattttctccccaggtatttttctgtcgttcccttgacctttcaaacaatgctttggccgttgccagtaaagaactcactcaggcttgctgtcctagactctgaacacatctgccacctctgtccaggtagttttaatattagtgagatatggctaactctatcccaccttcctgctgccttgggagccctcacccactctgttaatgctgcttccagagcattccccaaagtaggaagttatagaatgtcccgtgtggaaggggctttatactgagttctatctctcacttcagatagagtaactgaagaccagagagggaaaacaacttgcacagtcacaaaaggaggcagagacagagtcagaatagggtcccaggctcctcttggccctttccctttgagaattcatttctatacacaaatgccacacaggaattcaggatccttattgagtcggcattgctgctctcatttgtggagcattagctatatactatacactgtgctaagtgctttttatgtatgcttcatctgattcccaccaggtactctataagatgaaatccattttgcagatgaagacactgaggcaatggtatgctgaggctggctggtactatctcttgagagccagttgtgtgcatctcttcccaatttcacattcagtgacatcatgttgctagctaaaaatagactatagcaagagtatttacaccatggaaattggcaaatgctacaaatcagagcatttctttatcccctttcctcccaaagaagatccagtttcccagcgcaccacttagcttacatattagctaagcagcttacccaagggcacacagcagggaggtgacagagctgggacttttatccagggctctgacttcggagtctgagctcttaaccaatactcatactgctagtcaacaaggacaggttttcagtgactcatttactcttagactggagatgatgagtaggagaaagcagctgccaggggtctggtacataggatggtagcaaggtgtggggtacccatatctatagagaccgtaccccgccagctagagaaggatgcccccagaagttttcccagatctcactccacaccaaccacatcagcttccttactgttttccaagtttttcaagcatgctcccaactcagggccgttattgttgttcctgctgtcttaaatgcttttccaccgataaacacgagcttgctcctttacttctttagtatgtgtgctctttcttgaccaacccatctaaactagcaccccaatattctctactctcttcctttattttcatagcatgtatcactacctgttttcaaagcacgtatttgctttttgtccttctctttcagtggaatgcaagccctgtgaaggttggagctgtccctgttcactgttgtagcttcagagtagagagcagagagggattagataggaaaataagtgaatctcagctgtattctactccacatgccacctttcttagacttgacccaggtggtcaactactagctcacacattcaccagtaaaggcaaagggctttctccttggttctgtgatctcgtaggatcttcaaagtctaaaaccatcttctttccaccttggagcctcttctttcatgttctcaccgtccctctgaaaataggccaacagtcatatttgttggtgctgatttgcagacagataatagatcaaacattttcagaaggaacctttggccccaagaactaattacatccccatcttggaaggtgactgtccctgtgtcatttaaactgtgtaagagaatggtggaggctgagtgtgacctttggcaaagcccacacgagggtactcagggaacagccagcaatgggagaagctgcagtgagccctggcctgggtacctgtgcacttattttcacctggagggccacactgatgttgtttcctgcatttcttgggtcatgtccagcagtaaatgcataatcactcttacatacccatgcacatatacatacactcaacttcctttctcatttcaaaaatcttatagaaaatgtcaaccatagggatgggaaaaggatgattaataatcacctgcaatcccacccctgagataaaaattgtgaatattttgatcaatttccttttagtcatttttttcctactaattaacatctgtatattttgtgacccatatttttaaaaacttagtacatcatgaacaccttttcatgtcattaaggatttttatacacagtcacttttagtagccagaaagtagttgtatgaaggtaccatgatttgtataactcattcctgaccattggacaggaatgttgtttccagttgtatattatcacagataatactatgaggggatttctcattggtaagtattagacaaacagtggttattctcatggttattcacttcaatcattgtaaactcaatgccatggactgaattgtgttcccccaaattcatatgttgaagccttaatccccaatctgatggtatttggaggtggggcctttgggaggtaacgaggttgagatgaggtcatgaggctgaagctcccatgatggcattattgctcttataaggagatgaaggtattagactcattctttccaccatgtgaaaataaagtgagaagacaactgcctgtgaatcaggaggaacaccgttaccaagaacctaaccatgctggcaccagatctcagacttccagcctccagaactgagaaatgaatgtttcttgtttaggccacccagtctacggtattctgttatagcagtccaagctgagtaagacactccccacttcatgagtccttcacttgtacttattagaatggtaccttcatcttgaccatgattttgcctctaggcctttgcatattctgttccctctgtttggatagcccttccccctcaagcctctttatcttatttccacagattttttcttaccacccccacccaagcatacatttttttatattttgatatctctgaaatggggatgaattgaagggtcattatgcatatttgtggtagtaagtcatagactggagacatagaattcctcttcattgtctaaggctcagcccaggcagttcctctttgggtttaggctctcttctctgggttgcagtaacctccaggctactctgtcattgcattagtcagactatactgtatttgtctgctcattggtctccccctgcacgaggacctccttgagaacagcaaatgtgtctttcattcctttgtcccctgctcccagtagcccaggctccaggacagttgctgaagtcagaacaggtgggggtggacccagcccctgattatcttctgccctctccactaataggcaaattgaattatttcctcattccaggcccatggagagctcctttaaggagcccttggcgggtggggcaaagcatctcacctgtcccagctttgaggttaatgcccattttaggccatgattggtgtatttatttgctcagagggagggtggggagaaagcttggtgggtggaggttttggtaattcatgcccgcatgactataagagagcttccaggaaaccacgttaccagcatagcaattgttttcactgcatttcagaatgacattcaagagtcaacagaaatgcttgaatttcaactttacaaaagggcttgctagagatatcgcctttcccctctgtcccttttgcttagtccaggatacaatgaccatgaaaaaagttggccatttgagcttttcaatgcccttcctcccaacttttcccctttccctacctctttctgggcctttctcttttttctgagttgatattcccttatcttcctctgcatgacttttaactttgctttttattaattaactccagaaggaataaggtgcctgttacatgggaacacactgcacaaagttgggagaagggaagatcatcctttctggctgggaaggtgggtaaaggcttcgtgcaggaggcagctgattcttgaaggctgggtaggattcaaacagatgaagaagtggtgaaggaagaggataagtcattccaagcctaggcaggagcaaggcatggtcaggaaggtgagggctgaggctgaagcaaacatttatttataatgtttacagactacctgcagtaagctggcaactttcttaagtgagtaaaccagatgtcactcaggtccctggttctccagctcatgtgtctgcatgggctttcttcatttttaccccatgacaacaacccagactctaaactcaatacatttacaagtttgaaccaaaggaatccatgattataaaaatattggtacccaatttagatttgactggttattttgtagaggacatggaggattgagctcatcttgtatacttcactgcaagcaactgaaaatatccattagaggtttctgttttctcagagaactccccttagcctaccgtggtatggaggagtgttgctgtctccttccctcgcttacttccttgctggcccttttctctcctggattctttcctgtgaactctgcattcctcaccctttgttagccaactcttgccaccgtcacccacaacttgcaaactacagatccattgtgttaatcgacaggatcaatgatccagatcattgtgtccagatcatggcccttgggatccactcttctgcaagaggttgatttagctgtactttccaaacaaatgcaatgtcttccccaagaaaattctgatggcgaatgtagtctccctgttgttacgtgtacattttcacattcaactcaccacaacagtccttctaatatcttcattttacagagtagacaactaaaaataagagaattggcttgcccaatgtcacacagcagccaaaatggtggaggtgaaatctgaactctgtcattctatttttttaaaatgtgtaagagctacatcccatgcatggactgtgaggaaggtgactttgatggaagaaaggctagacatgtaggttgtgacctgtatttgtttcctatggctaccataagaaaataccatgaactggtggcttaaaccaacagaaatttattatctcacagctctagaggctgatgaaagtccaaaatctggttgttggcaggattggttccttctagagcctctggggaaggactcgctctatgcttctctcttagcttctaaggtcgctggcaattcttggcattccttggtttgtagatgcatcactccagtctttggcttcatctttacatggtgttcttctcttcgtgtctcctgtatcttcacatagccttgttataaggacaccagtctttggctttgcaacccaatgttgtgctaaactcctattattctcagtagggaaggcaccaggttctagaggccaaagaagagacccagagccagcaaatacgatatggagttttattagggacttacctacagggcagagaatctggtggcagcagtctggacaggacaaccaccttacatatagaaatggtccagcggcagcaggctggacaagataactgcacagcctagtggtggctggctgggcaggaaaatcacaactgctttcaaaaagactgtagtttctacatcacttaacagcctccccttaatgacctccacgtggcaactttcatttaacctagagctcagagcctcaatctcctgtacagctcttgttctatgggacgggatgggggctcagatgttcctcatgggcaaggaatgaatctgtgggttggttacgtctggattccctggctcagaacgcacattcaggtgtttctgccagacaaggtcattctaagggtatgcttaaattattgctataaggggcacttaccctacacccaccctaatccaggataaactcattttaactaattaaatctgtaaagatcatagtttcaaattaggtcatattctgaggttccaggaggacatgaatttttggcaagacattattcagaccagtacaggaccagttcatgaagagtctagaaggtattaccaagaaatttggactgcgcgcaaggggcagtcatgaagggtgactgagggaaagaataaccagagtcaacctgaaacccccaggaatctgattggctccgtgttctttctttctcacccagctccctatgccttgttgctttattaaggaattaaacagggtgggcgtccatcagcagatgagtgttttttgagagtggcagccttttcttctttttggaaactttgcatttgcctctgttgtgccttggactaatcagtatgccgcgtgaaactatttaaagcctgatgcattagtcacaacaaatctgctcctgctgggagttaaaaaggctgatcagggcgccagtttctttttggtgagcacagtttgtttttcccgttacttcatttgcatccagccccttggatttctcggacttcacgcacagagcccctttcctgaattgcccctggtacagagagagctgccaaggcctggtcaggccacctttgaaaacctttctgaggacagaggctgagacaaggccagggaccaaaacaggaggggctgctgggctggactgagctgggctgggctgggctgatccacggggaagaccctgatgcccagagaacacactgtgccagctggaaactgttgataaagcctgtggtgaccacttcagcgccctgctctgaccttttcccatctaatgtggggctattttaatgttgttttgaagctgagagagcaccagaaccttgggcctgctctcctggtggaaaccacaggcttcatctgcctttgtggtgttgccaaacccttgactgtcctataagggagcgggcttgagagtaacacagttggcctcaacgcgtgtgtggaggcctagggctcctgtttatttttagcaggagtactcaagcagcatggcagagtttctccatactgcctcataaggtgtcctcagattctggggctgcaggttgcacaagagagcaaccctggggtggtgacaagaagagagtttgaatttctgaattaaaggcttttgctcctctgcctcgggttaactgtgtgaccttaggcaagttgcttgacctctctgaacaccagttttatcagctataaagtagagtgggtaattcctctttatcgtaagattcagcagcatgaactaagaggatttctgggaaagtgcttcataggctgcatggtgtgtgatgggaaggtataagggacatgaatagccctgtatctggtgcacagtaacagcttacacttattgagggtatggtatgtgctatacattgttctgggtacttttcatggattgtcctatttaatctgcacaaaagccctaagagatactgttataatctctattttacagatgaggaaactgtggcttagagaatttatttgctgaagatcaaacagctaattaattgccaaagccaaattcagactctgcagcctgcagtcttacccccagtctcttggtgctgcctctctcagtgtcatcattatcattaccatcatcattgcccagttattggaacctggtcttcgacaaaccccaaaaatattatacattgtctctaatcctcacagcagcatcataatattaactcattgtaatatttacattgtggtgtaaatattatcccctccacttcatagatgaggaatgttgagaataaagggttttgttcactccgtttattgagcacctacatctctatttgaggcactgggacacaagaatgaacaaaacaggagggtcctgccctcatagaaagtatattttagtgtgaaggaaccaggtgatgtaatacctaagcacagtaatttcaagtaatactaaaggcagtgaagaaaataatgtaatgtgacaagtgatgggtcagggaaggcctctctgaggagggactgtgtgagatgaggcttgagtggtaaaaaagagccgcataaaatgtatgggcagtagagaggggctgaaggagctggagctggcgaagggtggtggtggaccagaggagcaggaagcagcgactgtgattgcaagtggggtgacttcgttataagaggcagtgcgggggaccaggaatccatccccaccaatgtatggaaggagacatgatggccaaggacaggcccaggtgactcagggaagggtgagctgagctggtgggcagccccagtggtgggtgaactgagcaggttgcaggggagcggggttcaggcttggggccctgtggagccctctgctattttgctgcagtgcagtcaactgacctgggggattgtgggttccctccacgccagctcgggctggttgtggtgctggtgcatgggggattgatgaagctggcaatcgccttgtgactagacccagctggctgccagaaagggagccaaaacctcaccagggaggcagagcaactgcttctgcccttttccacaacccccaggaggtcattgatcttaattaattatcccccctgaggattgtggaggaaccctcctgtctacagagaattactggtggatattctaaagaaccgaataagatccccaccaccaacttctgtcttgagagaaagaaggtgcttctgtgcaattgatcagaatgaaatcatagaactttggatctgaaagacacttttttttttttttttttttttttttgagatggaatcttgctctgtcagtggcacaatctcagctcactgcaagctccgcctcccgggtccacgccattctcctgtctcagcctccccagcagctgggacaacaggggcacgccgccatgcccggctaatttttttgtatttttagtagagacggggtttcaccgtgttagccaggatggtctcgatctgctgacctcgtgatccgcctgcctctgcctcccaaagtgctgggattacaggcgtgagccaccgtgcctggcaaggatctgaaagacactttaatgataatcttgtctaacacaccctaacttttaagaagaaactatggctcaggtattgtttgaatttagtgttaggaaaaatagtcggtgaaagtctttctgggaaaaaaacaaaaaccaaacaaatgcacttttcctgtcttagtaaacagaataaatcgattgcttggtcaaagagaggccaggaacaacatggagcggggcctctggtgctgggtactcctggggttggctcccacatcaggtactacttactagctatgttttcttgggcaaattgctttaagtctctaatttctcagtttcctgtttgtaaaatataaataataatgatatccacctcatggggttttttaatgtgaactgaaaaaataatatatacaaagtgctcatcacatcctgaaggatcattattcaatgaatgattgctgctgttgccgtttgaggcgcaggtgcagaagacacagatgagtggtgttgtggagcatgtggaaatgctgggggtggggggtaaggtggtctacaaatggcactgccgttatcttgagctcagccctccatagcatccttcaaagctgatttttttctttttgtaaatttccaaatacataggtgttatcctgtccatttgactctattttctgagagaggcaaatggataggataacacctatgtatttgaaaaagaaaaatactcccagttaagtgagagttccagcagatgaattagggtttaaaacagaactgtatcctcatttcatttcaagggtggcccagcatatctgctagtgtgagctttggcattgctcctctgagaggcaggctggagaatgagaccctctgtctaacccagccattctaggaccctgtcctttaccccattctcaggcccactcccaacccaactccagggcaatccagtaggtttataagatgacaattgatcttatcatcctaccagcatcatattatggtttagctgaaataatactggacagtgattctgttattagttatttccctcctggcttcaggggagaatgcaggcatgttgcaggaaaacagaagaaccatgcacaccaaccatcgactcacaagctctgagaagagaccatttgctggtgacgaagcactgacttgcccctttgctgggcttttcaggggcttggctgggtcttactatgccaggcttctttcccctctgtagaatggagtccctatcttcatgttatgcaaacggcaccttttcaaaataaactttagaggagtaagagagaagaatctagtgccctttctgagaaggaatttagctaggagaaccaaatgttgtcccatacactgggttaaaaagaaccagttatgaactacaaatgcagttgactttggccctgagctctatagggaaaagtagggagaaaaaatagtaacgaatcagcagcacaagcaatatttgcttgtgagttcttccagtcatgggcgtgaatgagtaattctgtcctgggatcctattgcctttgctttgtgccccaaggtatagagtttggaaaaataccagtgctggtggttcttctgtttcggggaataaagaaaaggaataccccattgggagtgctgttctttgaaaactgcagcttacctgagccctttgttgagatggaggccagaatgagtctgaaacagctggtggggaatccaaccacagggatcactcagaccaggacaacactgaagtcaagtttgctatggatgtccagaatgccaaaagagagggcagtctggaggccttttttcttgggggagttattcactcatttatcttctttttattaagtacctaccatgtaccaggcactgttctaagcagtgtggtgcaagaatggcaaaatttctattctatggaatttacattcttatggagagatgtagacaaaacacgagtaaacaaatacaaaaataagtttatttcagtgagcgacaagtactatgaagaaagtaaagttgaatgatatgctcaggagtgacaggggcaactttggatgaggggctcaaggaagaccactctgaggcagcagcatgaaaactgaacaatccaccaggtaaagaccagagagcatgatccaggcagcacaatagccaacacaaaggctccaggtgaggacatctgtggcttttcaatcaacacaacaatggccagtgtcactgcagcctcatgagttcgtggctgtttcagctttacacccagctactgtaaccccaactgcgatgtccactgacgtagccatttcctaggggagagggaggaagggatgtctagaactgctctaaggactaccagaaattactgattagaggactaatcctaccctcatcctcatctccacatttaacctaccattgagttctgttggttcatgctcccggttttctcctaggtaagtccatttcttttcatgttcattaccttcaccctggtccaaaccatctgcatccttcccctggtctactgaaccttgcccattcttcacactgtagtcagaatcttgtaaaacctcaaatctggctgggtgcagtggctcacgcctgtaatcccaacactttgggaggccaaggggggcggatcacctgaggtcaggagttcaagactagcctggctaacatggtgaaacctcgtctctactaaaaatacaaaaattagccaggcatggtggcacgtccctgtaatcccagctacccaggaggctgaggcaggagaatcactggaacccggaaggtggaggctgcagtgagctgagattgcaccactgcactccagcctgggcaacagagtgagattccatctcaaaacaaacaaacaaaacaaaccctcaaatctgatcatgtcagacaaacccacacacacatgccgaatacttcttcatgactccccattgctgtcagcataaagatccaaatccctacaatgatatgcaaagcccactctgtgcaaatccccaagttcttctccagcatgtttctagacatttgtggcttcattttccatgctctggccacacaggctttcttccagttgttgcaatatgctgtattagttctggcctcagggcctttgcagaagccttggctcctaatcttctgttctcctccatgagccttggcctcagcaactacttgggtatcagcatagctgttacttcagcagagaagtcttctttttttttttttttttttttgagatgacatctcactctgttaccaggctggaggacagtggcatgatcttggctcactgcagcctccacctcctgggttcaagcaattctcctgcctcagcctcctgagtagctgggattacaggcgcacaccaacacacccagctaatttttgtatttttagtagagacggggtttcaccatgttagccaggatggtctcaatttcttgaccttgtgatccgcccgcctcagcctcccaaagtactaggattacaggcatgagccactacgcccagccagggaagtcttttttattccttaacatcaatctactccatagggtcttttggttacctgtcctcaatagcacttcatattttccttcatacttcttagcacacttgtatttacctgcaatcttcctgcacttgtccataagctccaggagggcaggaaccttgtctgtctggttcactactttgtcctcagcacttaaaaagtatctggaccgcagtagatatgtgatatgtatttgttggagaaatgaaggaatgaatgctcacaaagatcttggatcttaaatgttccacttgaatatgctacttgcttttgacaaaatgaaataacaggagactgtctgtattttctgttccatttctctaccctatagagatggtgattgatatctggagtttaagaataaggcatagcatgcaagaattctggcagatgaacaacctgcttagaaagtctgttcttgccttcgactatcagaacagcattattttctttggctcaaaggaatctaagactgtgtgtactcagggaaatggtgtagacccacggtgtggagtcagggccaagggtgagacttaaataataattaagtgaaagagggttgtgtgaagcctgggggcgacactgcctttctcagtggctgcggaattagaacattctcccttgtgtcaatgtggaagtgaatgaattaggctccgttttatgctgtgcctggaaaaataccaatccgtactcgcatagtttctgaaagcaaaccccaaatgccactgtctcagctccatgggagactgttaaggaaaaaaaagaggtaacattcacagactatgggaaatatcactgaagtggaaaaagattagcgttgttgtttttttgtttttttgttttttttgttttttttttaccttttttgaagttacatacccctttggtaatgtaacaaaacctatggaccctccttccccttcactgccctgcccactgcaaaacgtatggccgtataacatctctctatccatggagacccctcgggttaaaaatcccagttagtgggtctgactggaaattgagcagaaataagctaataagagatggccaggaatctgaagtctaaaaaacaaaatagaagtagtgctctgtaattacattttttccattcctgaagttcttcgttttttagaacaagtggattggcacaggacgaacacgtgccttagtgaaatcatgaatgatgagacctctaggtcttagaggaagcattcctggagggaatcaaagtggccagccactctcagccactctcagcaccttcctggattttaactgatattttaactgataagcatgcattttataattaagtactgcataagaaaaagtattgtaatgaaaacatgtgtttatttaattgtactaaatttagaggtaagaaacaagaaaattttattgtccctggtctgtagaaaacaattccagacaactgggagaactcaatttgtccactgtgtccccaaataaaaatgcttcaacacaagcaccaaaaaaggaagggcatattcccaagtagacacagatgtattgttcatgctaacagatgtggtgttaagaaacttgaacccctggtttgttttcttatcagtaaaataggagagacaaatggagaattttttccttataggttgttgtgagaatgaatatgaaatacttcacatgtaagagtaagccttcagtacattcttttttcttttcttttctccaatagcatcagtgacatcatcattctttatgttatatgtgcgtgcatcttgcatgaatgtatatataaatgtctccatttgatgtctaatcatctcaaactggtcatgcccaaactggaactcttggtttctcaagttcatctcacagactgtttctcccttagtcttctgcatctttgtcagtggcagcaacacctgcccagttgttcaaactaaaaacctaagagtcatccttcactcctttctttccctcacactcatattcagttgcacatctttgccaatatgttgcaaaattgatccctcttcaccacactcactgctaccctcccagacactaccctcctgtcattcctgtgcaagtgtcctggatctgaccctcctgccaccaccctggaccctgcagtcatctctccatggtgtagccagtgtataggcattaacagatttacatcaggttgttccacttgtttgcttaggaccctccagtgacttttatttccagtgacttctgataacaccggaaataaaatttaaatggcttacaattctgtaggtctctatatgagagataagcaaactttttctgtaaaaagccagatagtaaatattttaggccaaatgggagtctatcacatcatcatcttcttctcctcctccttcctcatccttcctcctcttcctcctcatcctgtcctcctcatcttcccttctttccttccttccttccctccctccctctctccctctctccctctctcctcctcctccttcttcttccccttccccttccccttcccctccctctgtctccttctccttctccttccaaccctttaaaactggagaagctgaaagctgtccttaactgacgggcttacaaaaacaggttgaggactggatctggcccctgggtggcagtttgctgactcttgctctatacaagctggcctgacccttctctcctgctcacatcttcttgcccactgccttgctcactgtgctctagcctcagtagcttgctggctgtttgggggcacactggtcacattctgctcagggcttgcacactcctgttccctctccccgcaacattgccccttcaggtcttccatgtggcttgcttcctgcctttgtttaagcctctgcttgcagaagctctccttggagaagcctctctgagcagcccctccaaaatgctctccccactccaccccaaggacatgctatccctcagtggcttctctctctaggacttactatatcttcacttgcttgtttgtcactaatgccagcctagcatcagctcttccagggcaggtgccagctttgtctgtctcattcctcactctccctccctatcacccagaatagaacctggcacttagtggtcaatcagaaaaaatatttgctggatacattaataaatatatccatataaggacaattttttaattatataatatataattaatacatataaggacaattctgccatgtggccagctggttttcaacccctgtagtactactcatttgcaacaaggccctctttttaaatcctcagcccggttggctctgtgtaatgcaaagaggaatcggatgaaggtgccaagcagtgcttggggtggctgtggactgtgagaggccagttccatgtgctgtcatggtctgaagggtgaatccaagtgtgaacatggtgatgggggtagaggagagcttagccaggctttgatgtgaggggaactgtccagctctcaggaagctgatgtcattagagcatccctggacaataagtgctgagtggagccagtgctgatgtctcttaaggagggagtgaagtagctctcagagccagaagagtgccgagataaactgtccttcccagaaacacacagctgagccaacctgcaaaccaagttggtgtggatgggggctggatggtgcttatcagtcctggatggatcatggtgtgaaaagctggtagttctggagccactttatggagcatggtgcctctcagctccagatgtgaagcctcctactcctgggatctccttctataggccacttgggaatggcaactagagggaagcatctggagcagccagctataccctccttccacctccttctcccaccctgatttgctatagtccagaggcctcaggagaaatgagcttggatttgggtcattgaaaaagagagcctaggccccttcctagggcaatcataaaaggccccttggggggtggactgcaggggatgatcctgtggaaggctccaggaggacttggtaccctacacccttgagttttggctcatagtcagacgatgagtcttggctgaacctgatgccccaggatgggatggactgggtagtgagccaggctataaactgactcatgcaccaggcagggactggaccatccttggcccaggaaccaggtcagggaatgaaaagatacaagaatctcttctttggacttcccctaggatagaaactggggtgtatagatcagggtagcctgtacatatccacatttgggaattttatgtcctagatcatgagagtagctcttgattgtagtaaataagacagctgcataacaggagggaaaatgcagtgatagtacatgtcaaacttcatcacagccctgtctcaggagcccaaggcaggaggtcagatggtctgggatctaatcatgggtctagactgtgaccttgaaccaggcatttcacctttctgggctttagtgttttctcctacacaattataatggtaaaccttgatgttgtcacctcactgaattattaggatcaaatgagagaataatgaaagtccttgcaaagttaaaaatgctctagccatgtataacttgatccctagtcaagttgtataaagcaataataccaataggaacaataaactttcaatgagcactgatcatgtgacaggcactgtgcccagtgttcgcatgcatatctcacatggtccccacagcaatcttgagagacaggcatcattataatctgcatgtgcagatgagcgagcagggcatgaaaaatttaaataatttgccccaagtcacatattttccagggaagaccagaacttgaattcaagcagcttgtctctgaaggatgcactcagaccctgagggcctgcagtgcagatctccaggctcccagcccagccccctaggcttccttcaggaagataaccatgagtctgtccagtgaaaacagacccatgtctatctcttccctgcagacgggcttgatccctgccaactgcagagaagctgcagagcctgagcagagcctgatgtttaccagctctaagagctaagggttccagctgggacagcaaatcctcagcaatcctgggaaacagggagtgatgccagggcacagggtctcctccaggttatgaagagcagacacatgtggttggaacttcttcatccgggatgggcgtcctgcacgcacgttgagtggctctcaggaaaacatttccttgagaaagcagaggcagggaggcaatctctgaagggcaggctgtttttttccatgttctcatcgggaaggagagaagaaaaagcagtcagcacttcctctctgcagcccttcctctgggggcttctcatcccccttcacagcagcagagccccatggtgcagtttgctgtgcttgcctaatatcagtcagcgaagtagagtttgatgagttcagtcaacaaaaagtagccgataagggcttctgggcacccctccgagaatgcctgaggagccttttcaaggatggactggtatggcaaaaggacggaaaagaggtagaagaagtattgaaagaaccgtggcctttgtcctggcctagagaagatttgggaagccttggcacttgttctcaaatatccaaagggctgtcttgaggcaggctagttctatgtggactccatggggtggaggagggatggcagggactagtctaaggaaatacgcagaaaggcacagaagcttaggttccaggctatgcagtctgacaggcctgcgttgcaattccagccacactatttataagctgtgtgacaattagcaatttgcttaacacttgtgtacctccattgtactgtaaaatgccagtggtaccatattcaaaggtttattgtgaggactgaagatggtgatttatataaagcacttagatagtgcctaggacttttgctaataataacattattgtgtaaagtccacttgtcttgagaacctatgaggagggtatttggataggagctaataggtctaaggcctagtgtgaacctctcattaggcagctgtgcagctttggacagctcattcaacctctttgtgcttcagtgtccttctcaggaaaatgggaccatgccagccattcagcttagttcacagagcagttctaagaataactgccaggataactgatgtgagagtgtttttgaaaaatataaaaccaggttatcatgagttcttgatgttggcatttcactggaatatgaccaggaaggaagctgtggaaaggaattgagtttgctctggaggacctccgtactggttctgctctacaatctgagaaatgcccagaacagctgaggccaatcaacagcagcagtaattatgaccaatgcaatgtcatggacctgcgcagaagccaaaagcaagtcattagcagcacttgaagttttcctttgctaaacaatggcaccttcattttgggagttcccaggttgtcctctctggacttttggatagagggtgattgcagatacactctgtttctgctggtgcacctgtttcctccctcaactcatgtttgtggaccagacccagagtgccagcatccaccccgaccccagtggtgctcactggaggcaccctctcctgggctgggtgaaggaggaagccctggagtagattgtgtccaccgttgtgtatgtgtgcttgcaaacaaccatgtcctgggaggattaagatccctaacaaaaatggagttagtttacctactgtttttgttctaagggaaaggtttcccaagcctcccatcaggtaataattttttaacccacttcaaggctatttgttttcctttaattgttcaatcgggtaacttttagcaaccacattccctacagcaaaagggttattagggaggcactcagttcctcaatagttcccaggaaacatagaccacagccctttgggaaagacactgcttcttaaattgctaaccttaatccctagtgaccagaactggccaagaatgaaagggctgatcccacagggaaaataaaataaacaaaaccacaccaaccctcacccccaccaaaccacaaccaccgaaaacaaaacaaaacaaaaaaccaacagacaaatgcaacccagtgagagtttgagggcaactcctttctaaactgtttctctgaatcattcaaatacaaaaccagaacagagggcaaaagttagaagccattgaacttttaaaagtgcttcaacaatagctatccatatttctgtgcccacagttctgtggcaggaattttttttaagtttaaaaaaatattttttttttcaccttaatgaacccctagcccacctgagtagactagatatgcctaaaatgagtctttaaggcacttcccaaaatggccacaggtccccatgccctgaccctagaggtgcagctcctgggagggtgggaggagggaggaccagcagcacggaggcccttaaaagggggtcagaggtctcccaaagattgcacaatttcaacccttatctgctgcattgaggtggtgggtggggagggggctggagaaggagtcctcaggccccggatgttgaacagagcaaataaattccagaggcacctggcaacccttggattcatgggaatagcatgtctgctcttgggatatatgccctgggttgcttgggaccagtttgtctgcttgaataagtaaaaaaccacttaccctggagctttcaaattagtcttcaattattcattcattcatcctgaaacttattttttaccctgaacgccttctatgtttcgagcgttttgagggctatagagagaaatgacacgtaatcttcactctccaaaagctctccttctggtaatacttaaaagaaaatgtcaagtacatatccagattcccagcaaacaagtgaatctttagcctggtgagggcatcatgaatttctgatttcttcgtgaggtctcactcaagatgcctgtatgcctagtatttttggcttcccgtttcagtgcagtttatattcattacatttttgatggtacagtggaaaggggtctatctaggggactcagattcttctggaaaattagggagtaggatgggatgatctttaaattccctatagccctgacactgaatctgtcaattctatttaattataccaatgataagcccagtactattctgagtacacaaagatgaataagatagagtatctgttcctaagcaacttataatccagttgtaataatattaatgtcattgcttacatccataacaacaaatgaaatgcacctctctcctactataagaggagttgtactgttttaaaggccgtagaggagatagaaacaaagtactaagagcatttacatacttctgatgagtggaaaggatccgagaattcaccagcagttagttttgctctgagtcttgaaagatcaacgtgatatcaattggtagagaatggaaggaaaaaccttccatgctgagggaacagcctgagcaaaggcatggaggtgtgaccatacatgacctactccagaggagtaggcagcccacagggacattgggaggggtgataggagacactactctacccagaaattcttgaccctcatctgaccccccccattagaaggaagaaagtatctgagttgtcgggggagccaggaagtgacaaattaaaccctgtcaagggaacatactaaatgcagtggcatttagtatgcgcaatggggagatccctttacataattctttatctcaagaaaaaagaaaagggaagagaggaaggagagaaatcctttgctagcccaacccagccctttctgggggcgtattcattcattcattcattcgtaggcttgtcagtgtgacattgtgtttgccctcctgaaagccatacatcttactttcaaaacctccaacagccttcaaccccctgcagaccccagtgttccaaggctgaccttttggtaggaggcttactcccctccaaggctggtggaggggagacggcacctcttgtgctcaggccttccttgtcgctggcttgtggacaggagtcctttcttctctaggaaggattagtgcttttcttaaattcgactctgaagttctgaaaagcctaccaactgtgtacttccacaagctttttattttaatttttatacatcttcttcctttctttccaaggtctctgggtacccccagagaaggaaagagactaagtctttaagctacttgcaaaaatgtctgcacacagtttgccttcatgatcctagagatggcatttctggggtttcatttcctgcatgtaatatgacagtaatgcagacaactgcagaaataggggaccaggcagggaggcctgagttttactcctgtttggtggctttcaagtcagatgaagaggatcaatcactctccatctctgagcctttctctgcaaaatagcaaaaaggatccttttcagtattgctgtgatgaggtattttcagtattgctgtgaaaggtgtccagtaccatgctcaataaatagccactactatggctagggttttcatgcggcaggcaatgtgaagctcttctgtggtatttttatattcaagcccagctatttggaggcaaaatgggctccctctgacaagctatctagctcattccctcctccccatggggtgccacagtgcttctgatccttcttttgtcattttaagaccatgtaaaagctgacatccccccatcagccttgcctcatgtgtgggtggagaggcgtcagcccacatcatgcatgggagcagtctagagagcctactttgtctgaagttcccctggccggcccccaccgtgtctgagctttttcccattagtcattgctttggctgaaagagtggaagacccctgttaaactgaaatatgttatctgggaaatacattaagccattaacagctggacacaaattagtttatcagacagaggctgggcttgcagaatttaggagtgagaaggaactttatagatcatcagtttcttagtgaagaaaagaaggtccactgatgagtagctcttgctcaaggaaacaccagtggcaccttttgggatgccaggcctcaaccctgcctcctggcctgaacccctcttcattccaccttgatgagcaagatggacagtccaactttcattcaggagatatttatcatgtggctgccatagctgggcaggtgctgaaaattcagagaagcatgggaggcagacatgggagtgttgagtgattgaacgatgtgggacaggtctcttgtatggtgggacgggaaaggtctggaacagaggacaccactcagtgaaaggcagatccagactctgaggggtcagccccaccaggggctccacagtaccagaacactgggaccctacctcgtggctaccatgagagttcaagaatggtcatgctcagggagataggctaagctggcagtcagggccaggggatgggtcagaaagccatgagctgaaaaaagaggacaacagctggaaggcaccagaccacacttcagggcagaccttcataagcattgttccatgtggtcaacacagactgatctctttccgctacttcacatcaaaggtcttggtggaagattatggaaataggaggaaggagaaaggtggtaggaggggtttggtggatgaggaggttgtgagaagccacttctgtctctgcaaatctacagggtcctgacacctgtgaactcacagccattaccctttggaaccatctgtaccatcatgctggtgatatcaggcatctcttccactcacctcttcttgcttgggtcctcatacccatcccctgcatgatttcaacagacatctaattggtctcccttcctccagtctctacctttttaaagctatcttcttgctgttactaggtcttcttaaaatgggagcttggacaaatcattcccctatttataagaattaagaatagagtgtcctttacagcaatcttgcttgtcccagcctaccaaataaccccatgtgatgtgaacacacagaacctgccatgaactttcacccctctacacccttgcacatgctattccaccttcctgagatgcttctctcctcttgtcaaacctgccagaagcaggtcagcatcacctctgtgaagtccttccatgctccccagccttgtgcattgttcttttctttttgcagagtttgtggaggtcttactctgttgcccaggctggagtacagtggaaccatcatagctcattgcagccttgaactcctgggcacaaatgatcctcccaccttagccttccaagtagctgggactaaggcatgcacaatcacacctggctaatttttaaaattttatgtagagacaaggtctcactatgttgttcagtctggtcttgaaatcctagactcaagcaatcctcacaccttggcctcccaaagtgctaggattacaggtgtgagctaccgcgctcagccagcttttttctttatgacccagctgtacactatacaggcctcttttgtagcacctgttgcattacattgcaactgttggtgtatttgtccattttcttactagactgtgtgtgtgcatggtagggacacacacatacacacagagagagacacataccccagacaaggaatcctccctgattctcaacaccctcggcaaagctgggtaagtgcatcatggtagatgctcaaggagtgtttgctaaatgagctagaatacctatgacctaaggtgtgtgagatctgaagggaaaggtcacaggctttattctctttaattaaagctgaggcaggtaccttctgtatctccctccacaccttcccatctctccttgtaccatgagtggtattttttcacctttttccagcaaagattggaaactagttgctcattcaatgactttctgcagatgtatagatcgtaaatgttgtggctatcctagaaagtataatgaacctaatgatgttttcccagaaaatgtataaatccctgatcttgcagtattttcacacaatcaggattttggattctttatccagccactcaactccaaggaactttaggctttaaaaagctgtgatagagatatcttgtgttttgctctcttagccaataagatttgtcaagctttatttttggaaaaattattttaggatttgttttccaaatatataaatatattttaatacagaatatgctttttcaaatgacacatgctctctcatttctgatatgttgtcctagcctgtgccccttcccttgagacagcaaatattgctgcctctgtttcattcttcagaaatgtgtgtagagatgtacatagaagggcctcttgtagtcattcagtctaagttagggcccgaggcaggatgtgggatctgctgcctgggtctggctcagtcctagctgtagaggaagctgcatggacggacactaggacaatcatcaacagcctttcatttgggaaacatttactgagctcccactatgggccacacattgttctgggtactggggaacagtagggaaacaaaacagacaaggttgttggaatttgtagtctagtgggacaaggcagaaaagaaacaagaatacaggttagctaagttaactcagtaggcaaaacaatgacgatgagacaacagtaatggagtggaagagagtgtgggaacgagaagtttcaacattaggagtcagaagtctccctgaagaggtgccattagacatgagaccatgggcaagtctagggggaaacagtgctccggggagtgggactatcacgtgcaaaggtcctgaggtaggaatgatttggatgtgtttgagaaaaagaaagcagaccactgttgctgcaacacagctggccagagggtgggagaccaggttgcaggtcatagaagagagctgggatttttaaactctgaaaggaaatcaagtcctgaaaggtttaggtagggtgacaagttgatctaattgccatgttttaaagattagaatgaaaaagattaggaccaattttatcacctttcctcattatgaacagttttgactacggaaatgaatatataataaagcaatccatgatttctcattataactctctgccagtgggggagagccaggatttccatcctaggatgtcatggctgcccaaatcagaaacaagttccgaggtctgggtggctagtgccatctttccttggggagctgaaggattcttgagccttttcaggataccgaaagttgctggggacccctggagggtcactgccagatgagaggatgctggacctaggacaagggttgggcaggaaggtggggaggtccccagtcctcaaaggaaggcacccggggcctgtggcaggtggagcaggcagacgaggaaataaaggccacaggctgcctcctctgtcgctgcctgacctctcctcctctccagagggccttgaatggcctttctccagcagcggccaggcaaggtgtgtttggaaatacccaaactctgtccttcacgtggcaggaaataaatattgctgggaacgcagcgtgtgggctggggcaggggtgtgtgtgtgtgtgtgtgtgtgtgtgtgtggttagagttgtgggggtcagaaaatgtgtgtgtgtgtgtgtgtgtgtgtgtgtgtgtgtgtgtgtgtggttagagttgtgggggtcagaaatgcatccatcctgcagccatagttccaactgctccagggggaggcggctctgtcaacttgcgtgagttctgtgcagaaagaaaatgcggatggagatgagtgcgcatagtgaggcgccggctggtgtctgagctaagaacccatggggacccgggagccatgaactgcgctccacagccccttcccccggcctcacccctacccatcttctgcccaaggctctccctactacccacgccctccccgaaatagttaagtatcctcccaccaactccgaccatctttcccccttcgcgcccaccggcggcagtggcgaagggcccactgaagcgccgggtgccacgcggggcggcccgcgggccagctagggggcggggaactcaccagccgccgacccccccccccaccccgccctcggccgccgcggccccagcggcctccgcgctgcgaggagcgggcgcttggacacagggcgagttgtttgatttggcggaggcggggaggccggcggggagcgagcgagggaggcacgagagctgggcagcgcgggcgccggtctccagggtagggtccccgcgcgcagcagcggccccggggcgggggcgaggcgaccgcgggcgccggggatgcctggaggggccgcggccgagaggagacccgggactggacggccagacctgccgggcgcgcgggcaggtgcttcggctttttttttttttcccctcctcctttttcctctgccccttccttcctcgccctgaagtaagatgagcgtgatgctgtggcgctgggaacagaataacaccaccatgaagctggtaagggtggattgcagaccgcaccccctgggcgctgctctactttttaaccccccaccccgccccccatcccctttaggaactggcccgggtggtggaaagcccctgaaatgcattccgcacttggtatttcccttattgttttgaagctagatctcaggggaggtgtgtgtgtttaaaccaggaaagtcgatgtgtgtatgtctctggttgtgagtcattgaaggggggtgggactgggctgcattatctctccgtcccttccacctacgaattcctggagctctcttggattgcacacgctgggattgtctcctacgagcatgtctgcgccctcacagcctgtcccgggacagcgtggtccgcgtcccccgagcccccattgtgtcttgatactttggggtgcacatggctattgatctctactgcggtttggcttgtctgtggggaatacatgagccccgagtgagtgagtatgcaccgggtcctcctcccgcctctcacaatggcttagttctctttcaagcttgcaaagaaccatccagggtgcaggtactttttccctcctccgttttcaaaaataaccgcctatcagtcccgggagagctgaggatagcaggattttccttgctgcccaaagaagcctgagttgtttctccatcccaaagaggaaatgtgatcggaaatctctgggttttgcttttgtgaattgtttttttatcggatagtttcaactggcggggaccataattcccccattaaagtcagccagtgctgtggccaagtcggttaacccccttggatgttagtttccttctcggtaaaatggagcaagttcccaccttgtagaactagtgccaggataagaaatcatatttgtggattgcctggcatataaaaaggattcagtaagaaataggtatgattaataaactggaatgcatacttactggtgtgaggtctttaaagatgctaccaaaaacaaaaacaaaaacaaaaacaaaacacaaaaaaaacaaaaagaaagaaagaaaagaaagtcacagcagctgcattggataccaagatgctaaatcaaccaaagctgggtcttcatataatgaacttatttgttggaaaaatggcaccttgcttttcatacttcttgtgttatgtttggcctgcctaactttaagctactattttacaacttcatttaatgtgctgtaacattagcagacgttatgcacctttgctatactatgtcatgattccagctccctaatcctttcctggaatctttctccaaccagactggtgtggaagaggccagagtttcacataatttctctccaagctgtacctgagatgccactctaacaggcagcataggaaagctgggtcccgatctgaactgcatagggtcaggttgccaaacctaaatgcttttttaaaaagaagaaaaagaatgatttgccaggcagggaaaacgtggagcctcccaggggatggcttctggagcttggtggcaggtggccatggtaagggctgggatgtcttctccactccgatattgctgcccgtttagtctatggagggagctttcctcaacaagggtcaggggtcagcctttattgggtctgcctgaatctttagagctgtctcacttttcaaattaactgtgaggaccacccaaggtagttatggtccaccaaaataccctttccccatgaggtggaggaagggctaggggagctcaagcaactgggaagccctgagggagtagcagtttctgtcccgtgtatcccactgccccagagcccaggcaggaagaggcatgactgggtcttggcgtccagatagcctcagatatcctcagtgatgagcctcagcttttctgtgaatgctagaaaccactgatacatcattagctgaagtatcattagtttgcattttgttcattcacttattgattgatcaatttaccctttatttgttgtgtgttttgtgcagagcacagccttggtgcctgtgttcgttgtgaaagattttgcttgcagatgattcttggtttgaattccagccttgccacttactaatccctgaatcagttttcctcttttgtaaaaggctgttttacaactctctttccccaggttgtgaaaagatgaaatggcataatacaggaacatgatccagcatagagttggaagcatgtttgtctgttaaatgggaactatcattattttcttcagtggtaaatgagacataatctgtccccactctacgttgtactgttgggtgaatggttggttcttctaatgggccctgggaaaacaaacctttcttacctttgaatcattagtagccctcagcaggaaggagctccctgggaacatcttggaagtcaattgtgtgtgaataactgctccagaatgaggcctggggccagaggtgtgtgcccgaacttttatcactgatgcacttcaataaacatgaaatcagttaacccacagcttgaaaatgcattgttttgtttgaatagtagaattaaaggtcttgcttcatgttctattttaaggctaattggatcaaaaataaggcccagagtaattagaggcaaaacttgcatctttatatgttatctctgcaggggaatgtcagaaatgcacctgcccacctaggagagaaggcagtagctggtagatcctacatctgtccaaatcccatctgacagggtcacaggcctttgatgaaagtgagaggaggtgactgcccaggtccaaagcacccactgggaggggataagcttggggcacagccacagagcatactgtgggtggttctgacattcttaccaccttccctccacaccctagttcccttcttttaaattctttggacttaggcagagcaaggagaaacaatgaggccacttatggagcagctggtattatttgaggagtggtagagtccaagaatggcaaaaggaaaggcactgagagaggccccctggcagcctgtgctaatgcacggagtgcaggtagtccagtcagaaagacctgtagccagagctctgcacaggagccactgccttgtgacatgggccagttgctttacctcttcgatctttggttttctcattgtaaattgagactacagcacctcacagaattacagtaaaaattagggaaaaaaatgtatccggatttgagctcagcgttctgcaattagttggtggtcagtgaatggttgctcatatgatgacggacgagatgaaccagtagtgtgtgcatttctccacacacagagaaaagactcaacagaaacattcccaaaagtcaatagtgccaagttcttggggggaagttaccaggactgttttttgtttgtttgtttgtttgtttgtttttggtctatacttttccttatattctagttttgtacaaagctcatatgttacatttatcatcaagaaaagattttttaaattactgctaaaatcatattaatagctaacatgtgttgaacctttactttgagctttatgtgtatgattctatttcatcttctctacaatcctctgaaataaaaactattattatctccattattcagataaagaaattaaggctcagagagttaaatgacttgcctaagattccagagctagtaactttagaagtgctgctttgtctgatggcaaaggctgtaccttgaactgctgtatcagacaccctggatgcctcctagagcgctgcagggcctgctgctgaggtgggtctgcatgagcgtgcagtatagatgcctgtgctcactgctgcagttctctctgtgaggggcctctctgttcactgcaatcccctcttagcccctttgatcagggacatcctgggagggaggtggagaggagagtggggatgggttgggtcatcacccttcagcgtcttggaaaacacttaagggggctcttcctcaaaatgaaggagaaagtggctctgcatgaagaataattgagaataatgatgatgagggaaatgtgcccctgacctttgacctttccccagagaggcattggtcaaagaccccctgggcctgtccacagccaggctaacaagcagattaaaagaggtcagtgggttaaagggctctgtctgcttccctgtagttatattgctccctcccaaaggccaggatgctgtgggccctgcagaactcctgagctcccaggtgctgtgtttaaaagacaaatgctcctttagcttttttttttttaatccctaactttatggaggcttaattgccaaataaaaattgtatatatttaaggtgtacagtgtgatgatttgatctatgcatacattatgaaatgattcccactatcaaactaattaacacatccatcagcttgcttcagctctttacacgtatagactgattcccatcttaacaacttccgttttttttcctgactaaagctcattaacactcacatgaaagtattaccaccttcagctagaaaacaacggtcatttccactctcagggacttctaggactttctcctgctttccactaattgtaactggcatagatttgaccatctcccaggtactgaagtcatgtccattttctactaattccccaaaatctcaagggcaagaagttccattctttccttgagaaagcaggttggaatatacaggaatagttccatatgcatttccgctgtgggtaatgagccctcatagccttgatgtactttcctgaattgaaaccaaagcatgtgaggaaggttttgactttggttaattactaggaaaataaagaaaggaatattgggagggaaggagagaaagcctctgaaattagtaagtgacttcctcttaatgacattttgaggtaacacattttccttcatttttgtgttaatagagaagtagagatttataattggtccctttggtgacctggcagtgcttacattacttatgcaattgtttttgtttttgtgtgaagccagggaaaaaaattgttttgtttctggctcctgtaatgtaatgccagccacccagaaggcatgtggctaagcttttcttcagggtctctaagactctccaggacacatggaccaggctgccattgtctttccagctgccagcccagagatctgggctgggtgacccaggtgctgttcccaagggttgttctttttgattcagagattgttacagaaatgctgtttctaatataagagcaatagccagggaggtggaaaggcagtggaagagcctgacctcccactaagaatgggtgttagagtgaagggttagaatgagttgacagatattgtttaaacagggtaacaagaaggtgtgatggagatatttggctgggctgagatgtagtcgaggattgcccttgtgaccagaaataatatgtctggttataacactgtggagtgggacaagggtaagcacctgcattatacattatctttgtcatagtgagagatgagctgtgtgcttgctgggaacatgataggtcctgtggcacaaatgaatctataggaaagcaaggcactttaaatgggatttatcagctccagtatgtttactgggcttaggaaggtgtgtatgtctgtagagggtccaggagtgagtcttttgtttcacagctatagctttgcctatttttctagcattgttcccgatgtgaagtttcaggattcaagactactgatttctcgttccaacctttgtgggatccagtccattggtggatgaagtccaactcctttgtgggattcaaggccttttagatgatagcagtgttttaggtcttcttcagcagagcttccacatagaacctgttagttccaatcagcatggttggcctggtgatattccaatttcacgcttcttccatctctccatgttatcaccccatccttttgaagctcagattgagtcccctttttttaagaagccctccctgacttcttaaaaggagggcttttaagccctgacaggcagtagtatgaaccctcgtctgattctctaagtccttgagctgctggtggatgtggtatctttgctatcagactttgaacagtggcttcatgcatagatactggggatagtcaaaccccccttccctcctagctctgccaatgatctgtgcaacctggggagaatattgctttatttctctgagccccagtttcttcatctgtaaaatgatgatgatgataatcattccaaattcaaggttgttagggttgtttagtaagatacaggtattcagagcagcatccaagcacatagtaaatgctcaataaatgttagccattgttataatgataatgatcatgatgttaccttaattcatccaacacatttatgaaacatcttctaggaactagggaatatatgagtcaacaaaaaagtttcatacctatattttactggaagaaagagataataagcaaaacatgttactttttatggtgatgaatgctattatattaagaaaaatatagcagggtgagaaggatagggaggaatggtggaggttacctttaatgtaggatggttaagaggggctttattggccagtcgcagtggcttatgcctgtaatcccagcactttgggaggctgaggtgggcagatcacctgaggttgagagttcaagaccagcctgaccaacatggagaaacctcgtctctactaaaaatacaaaattagctgggcatggtggcacatgcctgtaatcccagctactcaggaggctgaggcaggagaatcgcttgaacccgggaggtggaggttgcggtgagccaagatggcaccattgcactccagcctgggcaacaagatcaaagctccatcttaaaaaaaaaaaaaaaaaaaaaaaaaaaagaggggctttattgcaaaagtgacatgaatattgtataataataatagtaattattattattattattgacactccttaggtattataccaggtgactgtatagtttattatcccaaccaagatacttctgagagtgaaagggagtactaatgataattgcattccctttgatcattgagatacagttgtaaattttggtcctgtcttgggcagagtaagttgcatttatagttgcacttgatcactccaagtataagagatagtatggtgtcagacagacctagattcaaatcctgggttccaccactatctgtgagatcttggaatagtcatttaacctctttgtacctcagtttcctcatttgttatgcatacctaatagggattttgtgagaattaaatgagataatgaacgcaaagcgctcagtacaggacctgacacctcataaagagtcaacagaaattcatcatcatcatcatcatcagatcgagagcaagaatcactctttttgatatctctgtgcctgggaaggggttgaggatatacaaggtggattaatgttagggttggaaatttacctgagcagtggacttgggagatgagctgaatgatctgccaagtagttgcctccattcattcttacagaatgtaagactcacacagtgtttaaatgttaccgatcgggtaggtgacttcatgctggggcagccacaggaagagtttggaaagtagagtccaggactaagaatcttgggatgttagttcaagaagaggccccatgacaagtggcctggaacaatctacttcacagtagaggaaggaaggacccagagagctgaaatgactggcccagggcctcatggcctgcagcctgtttcaatgcatctgtccttaaccatcctgctgactggcaaagcaaagattataaagagcgagaagagagagcacttagaattccacctggaaaagccatgtttctttggaaatgggccacagatgacataaccctgccatctcccattacctggtacttggctaatctttgcatgaaacttgttttggtgaaacttgagcctggaaaagccaactaaagtatattattttatcagtattgaatgcctcctagacttgagataacatttaatccaaagagtaaggtgatatttcctgagatagcaatgaattcatgttttgaaattaaataagatgagtttattgcgtcagctggcttttttttttttaaagcactaattgcagtagtaaatgttctgtccacggagtaatgtctggccactgtatggggaggagtgggagctataggcatggtagttttcattccttagaagctgtctcactgtctctcttgttaggtactattccagatttaagtatattttagcttaaggggacctctatttgaataaatagatttccaaccccagacaacttggggacaaaaaggtttcttttacattatctttcctgaatacatgctacatgctttctgccctttctccttcccaaggtgcttatcactcagtaaggatgactgcacacctaccttacaccaggcaaggagggaaaaggttctgtttatagaccttcttagatagccaagttggtcaaaaaagaaaaaaagggcaaagacaggaatttggagtttattgcattatcttcttgacttaattcccagaagtgttttagattctaaaaatgtgaagattaatgtacaattgaaatagacttcttcaaagaggcaattggtgttccaaggccatctacagtgcagttccaggatgtttcagctgctaagcctattatgtcttcacagtggcagttgtggttacagtccgctatttcatgccaccaccttactctcagctcatcttgaccctctgcagacacctgctatagcatcagcactgggaagtcagcactttagtctccatcatttttgtatccctagaaacaacacagctcctggcatacactaagtgttcaattaatggaacaatggtacagttaccatttcagtgtttcaatataatgcaaagttgaatcacataaaatgtggggttgtttactgtaaggtcattgagattgcatacagcttcatttgtgcctttaaacacagtcaccccaccagtaagttgggaccccataagagtactgatttttgccaggtcagattagatacagcttctcctgtgggagagtgacttgggtgtggagaaggaagccagaaatactgatggagctttctttggggaatccaagtgggaacctgggggagagggaaaaggggaggagttccctttcttccctacatagctccctactgtccagtttacaacataattggctagggaggctggactagagggaagacacttctacaaattacccagcaagaactgtgtgttaaggtgggtgtggtagcgtgcacctgtagcctcagctactggggaggtggacgggggtgggtgctgagttgggaggatgttttgaggccaggagttgaaggctgtagtgtgctgtatttgtgcctgtgaatagccactgaactcctgcctggacagcataacaagaccccatattttttaaaaagttagaaacaaaagaagaagaagaagaactgtatgataaccactctgggtgccagattgctgcatttttattttattttttttgagatagtgtcttgttctgacacccaggctggggtgcagtggtaccatcatagctcactgcaacctcaaactcctgcgctcaggggatcctcatgcctcagtctcctgagtagctgagactataggtacacaccaacatgcctggctaatttttattggatcttttttttttttttttttttttttttttggagatggggtctcagcatgttgccagagctggtcttgaattcctggggaaaagggatccttctgcctcagcctcctaaagtgttgggattacagacgtgaaccactgcacccggtagagtgctgcattctaaagcaggatgtagaaatcatctaaaggctgtagattaagcactgttggagatcagagggaggccatttgtgtaatgcattgatttcagaaacaaaaagaacttgatacaaatcattgtgaccctgggcaagttgtttaatttgtctgaacttccatttctctatctggaagattggtggagtccttttctcacagggatatcagatatgtttaagaggtgtgtatgcgatagcatgatagtaaacttagagaggtgctggaaaagttacctcctctgaattcagacccaggaaggatggttgtccttcaggaagcctcccaaatctaggacttggagctgggctgaaagaataggcaaaatttagagtgggagaaagggagggtcataaataaggtgaatggcaagtataaagagccctactttcttgattttatgaaatttctttcataatttagctagcaggaggggctcatgagtagctagcttttcctggctcagagagagcacatgtactctctcctctccaaaagaacctggatgcccgtcccacatgttactttctccattctaagcagtgtggttccaagtccaatttagcatgaatatttcaaatgtaatatgtcccagatgtagagctaagtaacccctcaaactttcccccacctcagtcttcccacttctgtaagtcggggtttctcagcctcagcacttttgacagttggggccagatgaccatttggtataggggctcttgtgtgtattgcaggatgtttagcaacgtccctggcttctacccattgtaaaatgtttagtagcaacacccagtcatgacaatcaaaaatgtctccgtaagtttccagatgtccccgaggggggaaaattgccccagttgagaaccactgtagtaaatggtcccaccacttaaccagctgcacaagccagagcttgaggcatcatccttgagtcctcctcttctgcattcattcatcctaatagcaaatgcttccgtttgagcctccccagtagatctaaagtccaacaacttctcatttcatagacgaggacaccttcacccttcacttagagaactgccataatctcctaactggtctccatagtttcactattgcctgcttccagtctgttctccatacagcaccagagaggtgtcaaaaaagaaatgtcactgtacctgtctgctgctttaagcacatgtcagtctgctcccttccctctctctcctgtacctcctttggttgctcaccaggccccggctgcaccattcttcctctggttcctcgaactcaccaagctcattctcacctgggggagtttgcccatggcattcccttgccctggaatgctcttctcttctttttacttgactggctcttatctctcaggaactctacctaagtggagctccttcacagagaccttccctgatccctctgtctcatgtaggtaccccctgcaaaatctgagtccctcattttatcccttcataacatctatgccagttagtaacaggctgtcttcttgaaatattgctggctctcatgagggcaagaatcctgctgcaatgcttttaatgcggccccactgagaggcataagataggtgctcagtaaatattcatttatttgactaaatcaacaaatgaatctcttcatctttcttgaggaagagagacaccatttctctagtttaaaattggtaattgcagacctctggaattattcttccaataaaatcagtaagaagctagttttcttctttagcttctcagtactgttagtacactgcctactaaagagtagatgcccaagaaatcactgttgaatagatgaatggttcatacttatgtaatagtttgtgaatgctaaataatgaaaataaacagattttaagcaagtagtcgaaatcccaaaatccatcctttgaccttctcaaactttcagggagagaaggtttgattctcctcttccactcccagtctaagagactgatgctattttcggccgttattgttattgttagcttatagaagtaaccggaatgcatacatggcatactgcatggcccatagtacatattcagtaaacatttgttgacttgaatcaaagcacttaggaaaaagaaaagagaattagactggttggtgtacagagacggtatattcaggtcttatcgtgaaaatgaaatcagttatcaggtcttgattagaggcagaaaaatttcatatcctgtgagaatttattgtccagtggaagaggtgactttggagaacaggatagcatataattgtgctaaatagcatggcactgttttgagtatctttgtagttgctttgaattagtgctggggcttcctccccctttctggaccagactcggctgtaagaagcatggagaagtaatgaagattttttacattctcagactgctttctgggaatcctgcaaagtcccgacttcttctctgattacccttctcatggctgagttcaagagcattttgaaacccggactttgaatctgggaaaatgctttatgaccatttttatgacctcaaagcaacccgctaaggcaagttatttccctctctttgccaagggggaaaaaccaaggatctggtaaattgcccaggatttcccagcctcggatgctatcttgtgggcggctctcatgctcccggctgcatgctgtcccttccattagacgtgctttggccgtttgaggaagggcctggtcagtaacctcagcccacattttcatggatttcatggtcttcctctggaaggaggaaagcccaattcagagaaccatatactgttagaactgcaagttttcaagacagagttctagtccaaaccaatccttttatactcgggccaactgacatccagagagggaaagtgatttgcttaaggtcacagcccaaagtctctgacttccagcccagggcattttttgttccaacacagttgtctcttattagaagagtgtcctcagcacccacgagtttttattcttagagatagggtagtacagtaagcacagaaagggctcagagcaattccttacacagcataagggctgtgtaaatgttgctttcattgttgtgaaactgctgcttattagctgtgtgacccaggacaagttatttgatatgtctgagactatgattcctcctctgtaagagtaactctggttcatcagaattgttgaatagattagagattatgtgtatgaggcacctacctgcctgtatagtaggctctgagtaaatggtcacatcttttactgccccccaaggtgtgaggcaaccagcacatcatgcaacaccaagtcgctaacagttgttcctttctgtttgcaaaaggggggaatattagggctggatctgctgccacttccagggaagaactgcagcttcaattacttttcacttaaaaggaatattgcttgttttttttttttttatttgttagcatttattgggcacttactaggtggcaatcactgttctgtgcctttacacacattatgtaatttgtctgcacaacagtccctgtgatgtaagtactattattatcctaatatgatagataaggaaactaagtctcagaaggtgataatttacccagagttagttagtaagagggaaagccacaatttcaaacccagaacaatctggcttgaaaactatacccttaaccattctcggccaggaactgtgccaggccctggttgcagacaagtcctgcccacgtggacatcactcacatcaaggacagcagaggaggatggagcaccttcccaggttaaccattaccacctcaccagctgccaaatggcaagagggcaaggcgttggaaccgcatctttgagctcctccccttccctatccagcccgccccttgtactgcacccaccaatctgctggggcctctgaacacgtcaagcccgccaagttcctttcctttcctggcccaggtgtggagcccctggggagcacacgctggcatgacaggaagaagctgtgcctgagagctgttcaaaggagcatcttaatctgcacatgagagagacctcatcccattgctgttggtaaatacacttggtagcagagttggggtgctgcagagttcttccctccctaaaaagagttagttccatgtgagaacatctgtgactggttgcctttctcaagcttggtaagcacttggggcaagccgagtgtttgggttggaatctcaggccataaccatccagagagcgggcactcagtctccccagaagaaagcctggcaggagaggaaggcagcaaggtgtggggaaagcataggacttattcaaatttcagctttgccaagcactgcttacatggctctgggcctcattcactccgctgtagtgtggagatggtcattcctctccacctaagatgatttttagaggggctatatggtagacatgtgtgagcataggtgctaacagagtgcctggccccaggagatgctttgcaatgttcagtttcttccaccatctctgtgcagcaccaatgctgggcccccatgagaggactgtcctgggcatggtgggggagagaagggtgattgttctgcacatgtgtgacagtttatataccgttatatacatgcatggcaatttatataccaaagtggtggtgggaggtaattaaatttagagactgacaggagatcctcttttctgcatgtctctccaacacacatatacttaggtccaggtcccaggctttaggagctctgtgccagtgacattccttcctgtcatgggtccctttgcctctcccttctcccataatttcttctggaagtcaaagctctcactgccagggggattttgttctaagtagtggggggcattgccccctcctcctgccctccgaaggatttggccagcccattggctcctcgtaccaagcctgacaccctggtctgctgcaggggagagcactcttggtaaatgagaatggtttttctgagcccattgaagatccgtgtcctaactgtatgcacctcacgcttccagagggaaagagaaaacctctattcctccttgctgctgtgacactgctgctgtttgaggaagctgggaggaaaaggccttctctgcaaacctgccagcaattacagaactcactcagactctgcctggatgcaggctctggtttatgtctccctttgggacatctcttctgctttatttgaaacttccggcttcattaataggtactcttaatactcttatctcagcatgccttctgggtttactgaagcatcatgccagagcacattcttccttggaagttacagtttgttctgggggaggttttaggtgcttaactttgagacttgggttgtgagggatgggggatggagggaaggcagtggaagacagggagcgcctgacagctcagttttgagtgagccattaaaaaaaaaaaagaggctggatgcagtggctcatgcctataatcccagcactttgggaggccgaggtgggtggatcacctgaggtcaggagttcgagaccagcctggccaacatggcgaaaccctgtctctactaaaaatacaaaaattagctgggcatggtggtgggcacctgtaatcccagctactcaggaggctgaggcaggagaattgctggaacccaggtacagaggttgcagtgagccgagatcatgtcattgcactccagcctggcgatagagtgacactctgtctcaaaaaaaaaaaaaaaaaaaaaaagaaagaaagaaagaaagaaaggatggatggaggtgctgccctggatttgtctcagtgcatgtatcacaacagctgattattgtcaagtttgaagatgtcttttgttttccatctctgatttagagccattggatatgtgtatacttgtcttaacttttatgatgattgaatttagaaaagccaatcaaatcagctaaaattccagccaagttataatgtattcactggggaagcattgattcggtgccaaagcatgcccagcactagcactctttgtcaactgcttttcttcacttccttctgtctctgctgccgtcacctagcctgggcctcttgcacctggactgttccagtagcctgggcttcctgcttctgctcccagccctgcctctctgttcattctccccataggtggccagagtggcctatggaaaacttaaatcagattgtgtcgtgccctgttttaacctttccctggctactcaaggaaacagaataaaatccgattcccctgtcctggcctggagtgccctgtatcatctggccgctgccttcctcctgatatcatctcaagtttcttgttttctcagccacaggcgcccacctcagggcctttgccttggctgttctgcttttccagaatattcttgcctggctcttcacatgatgcttccttctcattttatcctcggagaggccgccgggacccccaaccacagtgtccacttcagtccctacctcatgtctaccacacacttccttcagggtacatcacaaactgaaatcgcctcgtttaggggtatgtttacttgtttatcatctgcctcactcaacttgtagatgagccccatgacatagggacatgtctgcattattttctactgaattcctggtacctcacagaatatctggttcaaaggtagggcctaataaatatttgtcaaatgaatgaatgacaaatgacttgagcagggtcctctgaaaaggaacgcctgtgctcggcgttgtaaggaggctttcttctcactccatctaagccagcgatggttcctcctccccctcaactgttgttagggtcccacacgccatatatcgttgtcacattggttataatgtatcatctttctcacttcctctctgagagcctactcttatgggtagatttccagtctcttacatctttatagctgctgaagaacccaactcatatcttacaaaacaggtgtgatcccacccttcaaaaactgttttaagtcaatatggtatttacaatgaatataacaactattttccccagaagaccttttcccttctcaaacattctaggatatattttgtgacatctgagctaaaaatgaccatggtaggtccacagagaatgtggcttcatcctgtcctgttagcagggagttacttccttggctttgttcctaatctttcctgttatgccctcttgtgatgggtttagggggagggacctaagtgccagtagcatttttatgggatgtctagagagaaaatgccaacctcctttccctcacataattgtgaatttgtattcttgaggtaaacttacctctgcagccatggctctgtggcttttcccagttaatattcatttatttgaataatttattgcaaacctttcccctccctcaactccaggaatatatatatctcgaaaactgcatttaaagaaaacaattgcaataaagacaatcatcgaaattaatgatttaacttaaaaggcctagcggcatctttctgccctactcagtaccctatggagtaagcatactcagtggcttcctttcccaggtacaggagtgcaggcaaacaaggttgaataacctgtccagtgccacagtctgcgcaaggctattgaaattcatgactctttctaacagttttcctgtaagaccaaactattcccaagggcctgagaagagaaatgggacagaagttatttaaaatgagttgtgaacattctcagagccatctcatactgctgtcctgataagccaaatagattagatatttggaattccccagaacatttatttgtaagatttgatttaagtcaatgtcacccaagcttatcattctcatggcatatttagaatttttgccatatttgcctaccacttatgtcccttatttacttgtttccttcaaattgactacctaatctgtataaatttaaataaagaggaaacaaaatattctaatggtaaatgcaaaagcaatattgggcaaaatagaaggtaatcataaaaataaatatatagctattaagatgttcaccagtgtacagtctgaaatcttataaattataccataagtagttcatctactgcagtttgtgaaacagagatttataaagtaaggctaactcttattgatcagagagaaaggaagacaggggaatgggaaagcaaaggaactactaaagctcacataatggtcagaaagttttagtctaaacttcgtgataaatttgcctcctcatgttgattggaaagtgtgatgaaggtttgtctcagtgacagatctgcctttgtccttccagtttgccatgggacaaattgtggctatttctttgcccagcaaaaggttttatagatactttgagccctccttggccataggcatggttaggcaatatatactttcatttgtcagttccacagactgtagtggctttgagaaacccctttaggtttagctggctcctgaatgaaaatgaatctggattcccatggactcaggtagtgagcagctcctaagagtagggctaagcactaaactgcatatatataatgtgttatatagttactgagcttaaggagctaaatagtaaattagggaattcatcaatggggggatagcccaggaactaggaaccattcttggtacctcaaacaagaagagatttcatacagggaattggatacttatagaatttctggaagaaaagaaatgagaagttacaaagaacagaagttagatctaggggtgctcagctatagtagtttggccttgaaaccaagagttcaaccagaccctcctaatatgtattattacagcaagaaagagggccctctgcctcaatcctcatgcaggtgcaccttattgacagaacccaaattaaacaaacctgtctgctgtcatgagggcttgaaaatcctcaaccttctttattgtgaaccctttcttggtgccatatattgtactgaaaacgttttacatgcagtaatttagttcttcatctgaatgtgatttcttcccattttagcctcagagaacctagtaatcttcctccctgacaaggtcacacagctgttaggaagctgagccataatgctaaacacaggtcaggctgaccctgaaactggtgtgcccagtcgctaagccacaccacctctctgtggagggaaggctggtggagataggttggtagcattgtactactccatctctgactttttctcatccaaaccttactaccacatgcccctacacaccccgagcagaattctgcaagattgttagattaagccaattttgttctcttcttcctgtggccttgctggtacttgctgcttgttaccatgtagctgagatttgcacgctttctctgattaggtagtctccccatggctctattgtctcttggcacttggcatgcatttcggcccccactttccttcttctccatcccctcccatttccatattgctgaacccaggtgaggctgaggccgggatatgatgagtcctgagtgccaggctaaggatgctgaactttatctcaaatggtatgaggggtcactggccccccacacgggtttgagagccagagagagagtgatgtgatggaggcatgtagaggatcgagcaggagaatgtgggcctggtcggcatgagaaaaggccagaatcagagagcagctaggagacaagagcagtagatgagtccccccacttcccctccacccctcctggtctttattggcttttcaaagagcatgaactctttccctaacaattcctgaatctcaggtggttttaggctctcagtatggccaccagtggttttattgtctgttggcatttgccatccatttcagctgcagttatgttctccacctcctcccatccccatattgcacagttcagaaggctaagactaggttcttaaaagcatttttctctcacttgtggagagttttgatcttagactatttccaagggtcaacttgtaaatgccattcattctctctttttcttttctgtgctattttttaatgccttgaccatgatgtggaagatttgattgaccttctgaccagagatactctggtcatgacagtgagtgggagcaagccagcttctgtggacacagacaatgagatatggcagctctggttggaacgagccagttctagcacaatggatggatttttgaattcagaaatacctgctttgaatccctactctgccactctgtgtggggagcttatagaacctggagatctttcttagcttccctgggcaccagttttcccttctgtacaggagggataacagtggccctcctcaggtggtcctgaggactcaatgaagtcaccggtgtaaagctttcaccatgatgggcatgtgtatggtatgagttctggaaatactgttcacctttccttttcagcttgttgggatctgtaggagatggttctgatcagcttaagtcagttgatgtttgtctgatgatttagcctctagggcttttctttcctagtggccatggtgtgattccctccctctggtctccagtaaaggcctcagcatagacagacacacattccagacccacccaggagaagaccagtgagccaacccagatcacagttgtctcccagtgaattgaagtccacaccaaacaccagttgatggttcatctaggagatgcagtgtacctactcagtctagttaaaatgtgtctcttctttcctgtaatagacagaagtgcactcccttctcacctcaccaagagaagtgctcagacgtgactgcttgaccgctccaacttctctgccagtgcagagagcttgaagcttttgcagttctccaagcatctggcccatcttatctagatgacatttggaattttaatcttctagttatgggttttcataaatctagtttgaaatcatcactgccaatctcctctgctgtgggaaaatggctttaaaaagatgtggggaggggatggtttgtgcatgaatgaagatgacgagaaatgacacttgttgttggaagggaggctggccacggggagccctcatgcttgtttctgactgtggataaagtactgctttagtttaactcgactttggaagcctgagttggggttttggggatctgcaactgataccgtgtcaaatactgtgtcagatgctttacatgggttatctcatagctgccttcatgtgttcccattttacagatagagaaaaaccgaggttctgatatattatgtaacttgcctggtgttaccaagtggatggtggagattttaaaatctaggtttagctgacttcaaagcttgtagttttcctggcaatgcctgacttcgacctatgaatctatggactcttggaaacaaaatccctaaatttacatatctgaaatatcagcactaccccagtcagtattcttgtaacccctttagcacacatcccctccactccgctcagaggaaatgcatgaggtggttaaggagaagaggtgagcagaggctgggtcctgcaagaccatgccaaggtctcaggggctgggactttatcttgaggataataggatgatattgaaagtcctaacagaagagtggcatgaagcaacttcagcaactattgagggccgacactagcagacgtgccttttcccgctgattgattgaaagcgttcttatgcccacatgaattccaagagaccctgctgcttcatcttcaagaactccagggattctgggccacaggtggggaactgccagcatagaacattttcacaggacttagaaaggtaaggaagagtgaggagagcgttccagattacagatcttcactgagttagttctacaattgctgagtgttgtgtccctgtcaccaaaacctgctaagaatcaacaaccctaagtgagtagacagaactacccagtggatcttagtgtgggcagatagcatgagatttggaatcagttgccctgtacaatgaacccggtatctcccaaattaggtgctgggctgcaactggccaggacgcccgttatagtggtgcggttgggggcagggggagggtgggtggcggggtgaagaactgctggttcagaagctcctgggcagcccttgagcttcagaaagtctgtcacctgcccctgccaggacagtccagcatttacttgtttttcctgcagagcatgtgcaaactgttaagggaatagagtcccaagtgcagtagagataatgaggtcaagtgtgcgggtgcttttcggaacccaccaccccccacacctgccctgttctttcctttctttgcctcccccttgctatattccacatatattggtggggacagcagagccctgagagactctactttatatggacttaagtgactttcatcatttaggaggctggaatatgctccttttcacaagagtaatttgatggagaaattattttaactgtccctgggtttcagcccagggctgcaaacttgaataggaaaatgcatcttggcagtttcctggagctcaagggagcccctcatcttctattaaattgacacactttgtttgattaatgcaggtatgacattagtgatggtttcacagtgcttctcccaacctcttctatccatcgcccccactacacctctgtcctccccactagctagattgacgttcctccctgcacactagagtttgctgtcctcgctggcagttctgtatagggagagtggggctgggcccacttctgacaagcctgggctttgtggggttctctggatattctagcacttggggagcagcccacagtctcacatagaggattccagttggcttccaggaggccaggcaaggctgccccctcctgggaacatgtatgggcttcatagaagttttcaagtctctcatggtttgagaagcaagaaaaacttcattctcttcaacatatcaaatgtaaaataattcttcttcccatttctaagtagacaccctaggacctgctcaaaaaaatccctctcttgaccaaatcatgttgctctgaaaatccaggttctgaatgaatcttaaaccaaattatcttgaaatgcaagcttagtgtgctccaacttgatagcttggcgattatttgcttttccaaaaagagagaaaaaaaggagaatgggtgtgtgtgtgtgtgtgtgtgtgtgtgtgtgtgtttgtatgcatgtgtgtatagatacatatgtgtatgtgtgtgtgtcttttgggaacttttgtgctttcattacaccatgattaaaatgtgaaggtgtgtggaagcaacattgggttctccaaaaacctgggatcccagtctggtctgtagccttgggtcatttatttaagcttcagaaaatttccccatcctagacaaggcatgaggccaaatgaacagtaggtcttacctcaggacccagatgtattctttaattagttcctgataagtttcctcatgaggttgttaggactgaacatttcagaagcaagcacaacagataactttatttttttagggaggttttgtattttaacccccgaagtaaccttatagtttatttttccttgtctgattacaatctcccaacttgctgacagttcacctttgaaatgagtcagctttgatcagggatgtggcagccagacaggtcatttttactgtctgtgacttagtccaaccagtttggcaacagcaggaccccatcccaatttagggaatggaaaatggtagtcagtctgtggtggtgcggcctgccccctgcctgtgggcagcagattgcccctctcctctttgcactgactgactgggtctccccaaaggcagagtcctttgccagccctttgctgtcctccttgggcacctctccctttgctgtgtcctctccaagcccagcattgcttcagattgctaaacgatacaaagtgtgtcctcactgcctcccactttccttttcctcttccctctctgaggcttacgtctgcctggatctttttcttttcagtagagcaaggcagtttcggcctccacctgaaagtggaagtatagggtcaggcacatggacctcctagccctgaggatcatgagccaggctaacaccattggggactactttcggaggatgtggctgagctggaatctgcccccatcttctggaggcacagtgacaaagaagggcagtctctggctgaatctgagttcaaatcccggcactatcacttactagctctgtaaccttgggcaagttacgtcacctgtgagctcctattttttcaaaatgtgaaattaagaggacaatagtcttgaactcccagggttgttgtgaggattcagtgataagtgcatataaagcatgtagtacggtgtatgccacatagtgtgtgcttaataagagctaaaatcattgcttttattttaataattatcattgctgaccttatccatcatcacccttgtccggaggagaatagccagggtggtgagagaaccaaagctttgttctatgaagagtatttataggaatttgaaactcttttatgatattatgactcgtgaaagagacactatgccaccttttatctccgaagggctagaaggattaatcactgggggtcttcaccaaactgggaccaaaattcaattcagtgggaggaagagttttctgagattagtgtcaaatggctcttataggaggtcagaaggtctttacccctggcagtttagggaaacttggcatggagcttgtgcaagggattcatgcatcaaggaggggtgggattgggctagagggcttggctggcctcttccattcccagaattctctgattctgggttccaggagcgcctgtgctcttttttctaaagaaagactacctagaggaatacgccacactgtatagcaactttatgtgattgctgaggcctccccagccacctgtgatctgtgaactggcctcttgttcttgcatcttttaaataagttaatgtccatgctcttaattttggttttggatgagttattatttctagatacttaaagcaattaggccttatagtgccagtattggttaagaatagtacatcaccaaggcaggagaatcacttaaggccaggagtttgaggctgcagtgagctatgctcatgccaccatactccagcctgggtgacagagtgagaccctgtctctcaaaaaaaaaaaaaaaaaaattacaccaatgttttttcatcctggagaatggttttgtggggatgagagagtcgatggggacaggcaatttgcaggacctctgctctcccacacaaatcagccttctaggaaagcctcagatgcacaaatttagaatgtattttctttcctaagaagccattaaccctaactaggaaaaacagacagaggggagcagctgcttcctctctgttataaacagccattttgatcacagaggcctcctttccattcctttccaggtttgtcatgttcttgcacagagacggttgtgtgttccaggctggggtttatttttaccagcaatacagatgtttctgctcttgtgcaaaatttcattaaagttcaaccagtggtttgctgtgggaggaggctgccaaggttaatatttctgcgatgtattcccttctgttcattcttggcaccaaaatattcccaggtgggcaggttgtgctggtgctgtatatcaaaactaaacaacagaatcaccagtttatctgttgaactcaggtggagtctctgatcacacagagcgcatcagctttgtcttgaaaatgcaggcagggagatactccctctggtgagtatctgctcaccctttaatgccctttagcagagaacgcctcacactgcagaggttaccttgggggccaagaaagcatttggcagcatgaaatgctacatccttccactttcccactgaaatggtgggagcagagcttcagatatgtgttcaaatcctgtctgtggcttaggcaagttacttacctctgtagagtgtcagtgtcttcatctgcaaaatggaattagtcatccctgcctcaaaggatattgtgaggcttcattgagatgctgcatataattaattgagatagagcagaatgccctggggcagggaagatgcttgtgagaggaaactgttaaatgagcacttgggggattcccccaatggtagaggataatgtatagtccagggaagcccctcattcttctccctgcttttgcaatggaaaaattctgcatgcagcagaaccagttcttctacctgagagcttgaaaaaggcaagttaaaagtaatagcaatctgacttgtttgacgtgtgtttcctctgcctcgccccatctgtggcttatcgaattggaaagtggtcaaacaaacatggcccttgtctaggaacaattggcaagggtagggtagagcttgaaaggggtgtggctaggattaaaggtgagacaaaagtgatatggtataaggtgatctgtggccaatttgcttaatgacttttactacttactttctgaatccaggtctactcattaggtcagtgagaagagccagacctcatgcactaaagagagcaggtgtgtgtgtatgtgtgtgtgtccttcaggtctctgcagatttgtagggtcatctggttaaaaatagataatgttcatactcgttttataagtctccattgaagaagggaatatggacaaaattattcattttcaattacaacgtcaccaaacgtatgtctagttatttaggattattttaatcagtactctttgtaagctatccctctcacatacctcagtgcagtggcaattacagttcccaaccccaagtcttgcaaggtatctaagtgctgaatgaatcatcaacaagagacagtcttttttagtccatttgaaatgcagggtggatcttattttaatcttgagaaggtcagttatcagtggttgaatctgtggatggtcttgtgggaggagcattctgttaatcagcatattgtgataaccaggacattccatctcctggctgtgttgaatgacaatgacatagtggataatgtgttcccttggtggtttctttgtaatccatcaaatctgtccagtcttctgtctgtccttccatccatctatttatccatccatccatctgatagacatttattggcacttgagttgacatgaaacttacaaggggatatggagataatgatcatagatcctgctgttagagaatttaacatgtgaaataggggataagacatgtaagaaactggatgaaaaagccaaggaaaacttgggggtgaagagtggcattctaacccagtgcttttgagaaacccgtaggatcccagtttatgaagactgtgcattcccactgcaggagtaaaggcccagaggctggaaagaggtgggtctttatgaggaatcaccagtagttgaattgggctgaagtgaaagggaggagtgggaaatcagggcacctgcttaagtggcagttcttgaaagtcaagttaaggaagtaggacttggttctgtaggtgcttgggaatggtttcgtggcaggggtggccaaaggaagactttctggccctcatttgaatctggatgcatgctgacagattctgacaggtcttccaatttttaaagattaagtgtcagctgagagatgaggcagtcttaatgatgggtgatggctgattcagcaaagccaggcatatgtagcaccacttacattttcttctctcatggcttctttcttttcagacctcttcttatttttagtttttgtcacttttattaacagtttctccactgtcacaggcattcctctaagacctactctccagcctcacgtctcagtcctctaggaatgagaattttgagatgggggtttggcgtccatggcttcttctatctttggaatctgtcccttggctataaataaggctgttgcttagtgccagtattgatggtatttgcagctgtcctctgggagatggactcagacgaataacccattttcaagaggacatggccattaggtgacagctatttatggttcctattgactagggccaaacctgaactgtcactgacattaaaatttcatgagctgtgagctgcctttccttatcaggctgtctctttccatttatttgaaatatctaaccatgtttatctaggttcttcaaaagataatcttgaggaacgcttgtgttgtggctgctgggactttaccaaacgtacttctcatccccgcaacatccttccaaaccagagcattcacatctccatttcacagaagagaacactgagggtcaaaaggttaaactgctatcccagagtcaccaggtcagttcataagtgacagagccagaattcaaaccgacttctgcctagaatcaaagcctggataatttccatgaaaccatgcgtgtctgatttctgaacctggaatttcactacagaggtttttatttatttattttgtcccctgatagctcagtcacttggagttaagtagttgattgaacatgcaatttttaaagctcattcatgctgaatttgctttagtgtggtagccagtgttccatctttatagagtttctttcccacactcttatatgaaaataaacaaggccctaaaatgtcaggcaagattccttctggctttgtaacctaatgtattttatagatggttgaattctccagtgaacatttcattggaaaatattcctttcctgacttctgtttctccatcaaagggatattacattgtaagtgataactatttcttagtggccttgacattgcagttctgtgtaggaaattatcctgcatcagtcacttctgttgtcatcagattcctttcatctcaagtacctgcatttcttcaacttaaaatttggaacatgatcaggcctggggccagggagatggaacctcttgatctctcatatcagtgttgattcttagaaagaagaaggtatgatgattgataacctggtctttgaaagcagaaaaccttggtcgaatgtcagctttgcttcttgttaactactagaccttggccagatcgtgtctctgaatttcagttgttttattttaaagtggagattcatttctaaagaggggatggagaatttcttttggtattctcatagaggctttgtatgctgatgctttggtgaattagaaaaagcaatgctagagaccctcctttttggggaacacttaagcctcgctgtcccactcaccatataatagattttctaaatatcaagaagtaacttgggtgtcagtgaaatgcccctctttcctctttcggagataattatctatatatctctatgtagagtgtgatatgatagctaaccctgcctgggcatcagaatcctcttgagacccttgaagggaaaagaaaaatgggcatccaaacctactgactcgcacacttcaaatatgaggcccaggcatctgtgtttcttaaaagctcccccaggaactctgatgcacagctagaattgagactagtcatgtaaccagcatgtggggcaaatgtgatgtgtgcattgcggacaaagcccgtggagttttcctgccatgggggtaaatgcgttagcaacccatggcctttctgttcattcatagaaaatcccatggtcatgataatttgcaaagatagtttcacatgacaaattagaatatcccttccacaatacaaaccaaagctccaaactggaattctggtcagaaccctgaagcaggagagtgaaaacagccggcctcctccaccctcaccttcctgctccacccccagggagctacacagaagacaaagatgcttatttagatgctgccttcttgagctggtttcctgttctgctaaaagctgggcctttcttttttggggcacatttagggtccctttttagaacccaaaatgcacctatgtgcacactctctccaatgagacatttgaattccttgccccaatggtgggggctgcaggccaatcccagcctggaaccatcccttggtgctaccactgaaccatcagccatgctcttctctctccctctagattctcagggcaggagtcaggccccaggccacagcatccctaactgcagggatatccactgcaggctccccagtgaccccactgaagttctcacccacccactaggtttgattgggtgagcaaaggatgtgctcatagcagtgttctccaatgataacctcctctcaaaaaattctctctctacacgttcacctgtttttctatcctccgtctgatacagcaggaaaagtcgtgaaactgactctttgatattccttgaaattctgcattttgcatatttgtcctgtgcttgcttactttggtaaccactaactgtggtattggtgcctcagcttaagccaacttaggagtggccactctgtcatgctgaattaccttcatagtggcaggtggctgtcaggtgagatgagcttggtattgagacctggctatgcgtccttaagcaagtgttttaacctctcttaaaaacaggactagtcacagaaactaagtctaagattgtgaggattaaatgtggcaaacacatataaaggacttagtgtgtggcacataggaagtgctcagtggtacccattatccagcctcagttccactaaaactccagccatcttagctgccctctttaaaacttcattcactgaggggcaccagctggagaggggttgcatcaccactccatgggggaacactcctctagctcagtcagctcctgactaggagctgtcagaagccaccaaggaaaggtcccattgagaactgagcacaaaagcggggtcacaagagctaactgaattaagcaagttatcaggcagtagaaaatgcagttagatttgcatccatgaagcagatggtctgcacaaaatgattaaattagttttattaagtttggaggaattaatttgtcactttattttttcttttatttattaaaaaaagaagagatgtgagtttgttatctctggcaaaagagatttatagcaagtttatctgctagtggaaaacaagagttatggtaggaccttaaaaaacaattgtctttttattgtctattaatagttggtacaattatgtagaatgtggcccagagaatagaaatgctgccacctattgctggtaaaacctggcttatgtttccagtcatatgggggatatttttttccccttagaaataaatcttcacttcatgggttattgagtatttaattcattttggagacatttttttgctactggtgttcttaggatctgatgttttctagtttattgattattaattacaatgtcttacatcaagtaaacttgagggaacctctggcatttttgagtccttcttttaatggtgaggaagaaccaaatgcagaatctttatctaaaaacaaatgggagcttttgagttagagctcagggttgttaactggagattcccaatacttattgtttgggcacaaatagttctttcatggcccttttgaatggatcaaagcaaaacctggagttttgaatggcttcttttttgttaagtccttttatcctgaacagttactaatgagtattctaggaaattcatgcatgcaggaagaatttcttgtgcataataactagggtataaactttatattcacatacccatgtatgttgtttgtgtgtttacacacacatgagagtttctgaaattttctgatctcaaatcaaacatcaggctagcattctgcccttgaaatggctaaatccacatgttatccatggaggattaagaattgggttttcaaacctggttgcacaccatagtcaactatggagctttgtaattgttcttttttaaaaaataaactttaagactagatttaattttacagaaaatttgatagtacagaaagttgccatataccccacccattattaacaactaatattcacatattagttagtgaacccatgaacccacactgaaatattatcaactaaagtccatactctattctgatttccttagtttttacctaatgacctttatctgtttcaggatcccatccaggatactacatttcatttagctctcatgcatccttagacttctctgggcttgacagcttctcagacttgccttgtttttgatgcttctaatggttttgaaaagttatagttagatattttgtagaatggacatcatcgctattgccccccaattgggatttgtctgatgcttttcccctaattagactgaagttgtaggttttggagaggaagaacacagaggtaaagtgacatttttcatcccatcctatcagggtcatgctatcaacatgacttgctaatgtttatgttaacctcgatcacctggctgagatagtgtttggccggtatcttcactgtaaagttactctttcccttttttccatgttttactctttgtgcagcccacacttaaccttgagagcagaacatctacatactttatttgaaattctatttacatggaagatttttctcttctatttatttagtcaatcatttctttgtggcagtatcaattatttcacactttgacttataatccaatactaccttattttgttgctcaaattattttgagcttggtcagctttggccattgggagctctttcagttggctcctgtgtcactttgacatactccatcattgtgttttggagtggggatatatgcctacattttggcactatactgtgctccaggcttattttaaattcttcctgccccagtccaagaatcatttctccaaggatccctggttcttttggttggagaatgctattgaaaccaagatcaggggctagatctgcttgttgctactgggctgttgttatttttagaacttttcagctgaaagaacaaggatatgtacacgtatctacgaatatcctatctagattcctttacgctgacatgctatatagatcagtatgtaatttatactgataaactatactatagtttataaactgaaagcagtttttagtttctatagagtcttcaattctaatccattaccacatggctcatcctagccttccatctttgttcatctgtaagctttcactccaacagtgagaacatcctgtgaagcttgttaataaacacacctgggcctgggccttatggcctgaggttgaggtagatgcccacctgggattttggcatctgtattttaataagctctacacagattgaactctcccaatataggctgtcacaatgccatatatttctcctttgtaccttttgtcaccgtttccctttggcatctttttataatatctttatttgacatccttatttgattaatatctgtcaactccctcaagacaataggctctgtgtcagttttgctcatcattctgtcctcagaaagggtgcattgtaggtatttattaaatatttgttgaatgaatgggtggaatgacacacagcaacactgaggaggaagagaaaaatgtgtgtgatttatcgaactcttcctacatgctaaacggctgtctagttgctttctaaatattatccagttcagggatttgaatcaggtccggctgacatcagaatccacaccctttctgttgtggagttcctgctggtaggaagcctcttgtcttctgctttgcatgtcatgggctctcctactggactggatggagctgtgtgggtggccaaggaggaggtcagagggggagaaatggcagcacccatttagagtgtcacccaggcctcattaggaaattgactcccatttggtttgggaaggggggtgttttttcctgccttttcatgctcacaatgaaggtgacattgatttacaagtcagtgggttggagcagggaagggaggcttctatgggtggaaaagatcaattaaatgattatcccagctgccacacactaatgcctttcttactgagtttcaaaatcaggaagcagaaggttaccacatttagccttttacaggaaatctaattgccaaccttgtggtgccaaggtttattagattgggaagagttgctcttagtggctggcagtttctggcatgacagaaagctttccactggccacctggaattgtaaatgactgcctcctcttcctttttgcgtgcttttgctaaagttttatgcagatagccttttgtgatttttatctttttgtgatttttatctggattctagggggatggtacttaagcttggtaagcagtcaaaaaaaatatttattcaattcctactatgtgctatgccctggtctagtggctgagaactgcagtggtgagcaaaacagatacgcgttgtctttagaatcctttgcctggaatggtcttcctatggcttagtggttcccagactgtagtatgcatgaggaccaccagaatgcttgttcaaacccagtctgctgattattttttccatcgcctttccatggtcctgtccacattgaaaaaaggcaatctcaagagcagaccagaattcagtccagcaagcaactcttgcacaaattgcacggctaagctgccaccccccacaatttctgattcaataggcctggagtggggcctgataatctgcatttatgatgagttcccaggccatgctaatgctgctggtctgggagaaccaccccctgagcctttgcatggttgctctcttcttatcagttgggtctctaatcaaatattacctgcttagagaggccattcttgatttcccaaccacattatccctccactcctggccattcactctctaatgcatcttcatagcatttattattctctaatattagtttgcttattttttattaccattttgtctctctctcctacctctcatcctcagtagaataaagcctcatgagagcacttccttagacactgttgaatcctctaagattatcagagtaccagagtatgtgctcaataaatacctgaatgaattaaataattacaagagtaatgagtcatatgaaggaaagacctaagatgccttggtagtgtaacaggtagacctaaggtggagcaaagatattgcatttcatcctacttggagcagtttctagatgtggccttaacacctgatttaaacactgcataccagagttttgtcttcaaggttacaggctgtgggatttgtctgcgatcatagcaggccactctggatttgcttagtttttccatcgcctttctatagtcctgtccacaatgaaaaaaggcaatcttaagaggagaccagaattcagtccagcaagcaactcttgcacaaattgcatcatgaagttgccaggcccctatctctgagcttggcaggaggcaaggcctgaaatttacttcttctaataaccttccacctgaagcctatactcattcccttgttggaatctggaatccggcacccatgccaatgtctcggtagccttttcataacctctacaaagttgaatgaaggctcaaactcttctttgcaggagtgagacctttcgatgaaacatgtagattcctctcctgcactggccttttagagaaatgtaagggcaggcactgttgttttttcttttcaacagagtcaagcaaaagatgaggcacatggaggcaccatgcgactaaaagctctgaggatgattgtcaaaaccccactggaggagttggaaagcatgtaaggttttgctcttgtgtggcctcagcagccactgcctggttcaagtgaagtttgcacagtcccttggcctagagcttcatgcccagcttttgccaagcgtgggccaagtgggggaatgattccccaggtttgtttgcctggggcagccaaagaaacagtgatttatttcccctgagtgtgtcatgaaaatgtaagcaccgagagttggattattttggagggtgagaatttgatgggggagatggagatggaagaattgcagcagtttggagtcagggctgggggccagagggccgcccagtgggttggggtaacataagctgccgctattcaggaggtggcctgtgtaagaaaatctgaccacagcgggtgcgtgacttcagctaaaattaaccttggaggcttcacacgcttccacagtgctttgaactagacactcccagagagggcatgggacgttgactgctgaggactgcgctgctgctgtgggttgagccatgcctgtaagcatcaacttatgggttcccgctcggggtcaaagtcgggattcctgtgaccattataaagtggtaagcaacctccagggatgttggcagggtctctggggagagacaatgaagtttatttgaattggacttgtgtttagagatggtttcaatttattttctatgcagagcagagaccacgagccctccaagcaggactttcatctgtggaaagctagaagagctaactgccacctttgtgctgcttttttgtttcatatgtccgcccagggtgagggctgggtggtgtatttttagagcaggtagagaaagatctgtctggacattgttggtggcctgagaaaatacaactgcataaaccaaaggccaagctgaggaagctgaaattgggaaggtcctggatgtcaacaggtgtggcaggtttcgcttgttttcttaattgtgggcctcagcaggtgcaaaagagttggaggagatgccagggagtactcctgagggcttcattgaaggagggacttgcttgggggaaactggaagcaatttcctgttcagtgagacccatggatgtcccgggaagggcccactgccctctccctcccctggccagggtgacctgaatggtatcatttaagctggaaggcatctgtacccatggctttccacttgctgccgagaatccatttgggagcatgcattcacagagcaaaaaggcaagatgcatttttattcctttatgcctccttaaccttcagacagttactgtaactcaggggctaatggcagtcctggtgcctgcagctgtgtggcgctctggttttacaatcagaatggccacttttttgtttgtttgttttgagagagtggatctcactatgttgcccaggctggtcttgaactcctgagcttaagcaatcctcctgcctcagccttctggagcagctgggactccagacttgagccaccatgcccaggtagaatggtcactttgatgtggtcagaggcaatggctttatgacagagagagaaccttcttagcctattcttcttgtaaaaatgctgtagtttaccctcccctcctaaaacttatccttctcccccacctatctaacccaacttcctaggcaacattagcattattaggtggcttggcaggtgcttattttctaggaaagagtgtgcttctcttatctgcttaatgcttactctatacagctgaccttggagtgatctattataaaaacgtttaaacccgcaaagcatttgctttggtgagcagatattctgtgtggccctttatgtacaaagataagaacgatgtgggtatgaaaggtgtagggaaaaaaacccctgcatgaagatacgttttcacacagttttgaggtcattttccatgtgagccactttactgagtcctctgagtatttgatatcctcttgttccttcatcctctgggtgtgtggctcattaaaggtggaaggctgctgggatattggacatgtgtgtcgtttgctctagatgtgtagcactacccaggccaagcacaattaatggggatgtccctgagttctcattattatttttaactcctggggtctaggctcactgccctgtggaagagatttcttttgagatagaatgttaaaaatagacatttcaataggaggcagctattgtatgtggttctgaagttggatgaacacatcttatatgcctgcatgggaattcccatcccatgctggacctgggtgattagacatagaattcaaattcccatcttcataggaacacaaggctccttccagttccatcctagaacttcttcttcatcgtggtcatctgaatgacctggcctgatttttgtaactgccttgtggcataaagatgactggactgagttggaatacctggtctgttagctggacagatgctaaccttgtccagctggtatctcactggcttcatccatgcaatggggagaatgcaagctgccaccgcccatgtttcccaggattgtggtgaggctcagattggattgtatttacaaaagaactttataaatggtaagcactgcagacaggaggcagagacagcactgttgttaggactttattattcttcttgagatgaatcaatcagggccttcttccaggactttggagaataaatagtatctttgtgcaaattgttcttttgtgctctgggccaggttgtcccctgggtagaggagacaccccttctttcctaggtgccagcttggtgtttggtagtcttcgtagtaaacgcctagtataataaaaataataaacatgaaaaacccgagatgccctcaggcctgagagctctgacatctgggctggagaagggcccggggcacaacggtcatttccactgtggccaagtctcttggccatggagttgccgagaaaggaatgaggctcccaaatggggaaggagcaggcaagcgcattcctagggccgggcagcgccagccactgctgggaattgcctgccttccagagttttttaaagcctttgctacacaactttcccacaagtgacacaacagtctttgccaggttctgtgcctctctgcccaacgggctggagggccatggccatttatgagaatgtcagatcttctctagtccctctgtaccttccttcacccctctgtccgttacccctccctgagtacttctgcaagtgtgctcataggtgcttcacattttttcctcattcaattcttcatctaagttggtgcagtagatgctattatgatctccacttcacagatgaagaagctgcatttgaagagtttaagtgacttgcctggacttggatacattagcagaaaattcagggaagtttatggctatagaataacatcaacacagaatatccgccctcctaagcaaaagcttccagggtttaaacattttgcaattgatcattctgaggtcagtgctttatggtccattgtttgtggttggcatcattatgtaaaaatatgtaaatatacctataatatctattatttataaacaaaatctaattttcaggcccttccgcctccctcttcaggtgaaaccagaggaggctcccaccacctttttttttcccctctgtgccttcggtcacagccccttatgcagaaaaagggactccacctggagccctctctggatctacttctcccagataaatcagtcggctgtgtaatctttcaggaaacctgacccctcatctcccaggggaaatccttaaactacccaccaccccactgctcaggtttcttgggtaagaaacatcctcaaataatcaccacgagtgcacacagtttgcctttggtgttgggaattttaataagcaatgtacaccttatatagccactcacctgccctggtctgaatggccctaagaaaacaaaaacaaaacaacaaaacaaaaatcctttaccattaaaaaaaatctcccaggctttccagagtgattatatagcctcacatcagtctcctggggttaaagcattgaggatcccattggaaatgtaaatgttttttgggaactgtgactcacctttctctgccagagctgtgtgcctgggacctagtaagccctgatggaatggaatgtgggtcaggtgagttttgatccccaagtcaggcagagacagttaggtccagtgtctgggaatgggggaacacctggagcggggcttttgggacgcctcagtgggtgatgaggtccgagttgggggagggagggcctgggcaaattgaggatggtcagtgtttgggagaccagtgccaaaaccaaagacactcatgtgaaaggagggagggggtggccaagagggcctttgagccagcagtccttgagcaggtgctctgtaacaagcacgctgagaggtcctgcaaagggaaaacttgagctcatgctctacccacttggccctgtaaataaagccgggtcactctcttaatggggagtaactgaaccttggctccagctcacttgctcctgtcccttcacctactaggaagcggaacttggcacctcttgtcctttctgagaaggattccacttgccctagaaagcaccagtaagaatacagattgcactggagatctccaaggggagagttcggatcgtattcagtctccctaaaggcccctcgatctcatctccaagccttcttgcccacccagatagcctctttgcaccccacaggcttcccagctccagatcttacctctctccctgaattccctttttttcatgcaaagcattttagcacagtctactgccccctaaatttgcatactcttacccatcattctacaaaacaaagagatttccagtttgggggaggggtaggggtaaggagggaaaataataactcatgtttttttcctgtcccacctgtgtgtatttagtgatttttttttttttttttttttttttttttttactccatctcacctgtctatactcagtgacgtttaacagttggctctccaaggagaaaagcctgataggtagtacttgccaattaccatggtgtaaatccttctaccaagactgattttaatttacccactctgagctgggaagagatgtacagtagtgcattattatatagtatttccctcatacagatataataggtgtaaataatctcatgaccataaacaatagtaaaatacagtaaaataattagaaagtgatgagttttaaatatttactatcactttaaaaatataattttaagtttatataatttaattattaaaatagtggctgtagttaacaatcagctccaaaatttactgaaaatgttacaaccaactctcttgagccagtccatgcctgccctggcataccactgtatgtgtgtttgtatctttgaaaatagcactttagcatccaccgtcgggtgggtcctactaccaagctactgaaattgtctcatggcagtgttacttaccagtgcctgctgtgggccttttgctatgactggtctaacagctacatgaaatatgttggttttatggactttataatctaggcagtgaaggggaacatacttattcatctgtcccacccattagtccatctgtctatttgtgcatcccccaccatttaatcattcatctctttttttccacccactcatccacgcttccatccatctgaacattcaccagtctgtttacccagatcttcctccctcccttcctccatccatttttactttcttcccttcatccatctacccacccaccagtaaatcaatgagtgcttgtttatcacgctcctgtagtgagtcaggtgttgtgcttgtgttttaaatatgtataaaacttgttctctactctatagaagctcctgattgagagagatgtgagtagttacaacagccaggataaaggcagatgcaaagtgctttcagaggtgagaagaaaaaatgagtaattctgttaggagtaggcaagcaggttgggaatggctttacggggactgacatttactttgcttttcagatttcaagtgggcatttcctaggtggtgggggaagggcaccctaggcagagagggcagcgtgtgaaaaggcacagaggctggggagcctgtcccacagggttgttttaattgccttctctgaactcccagttcacacagaagcctggcaggcagggttggcttctaggagaagggggagttctgctaagtggaggggaccagggaggcacatgggaccagagaacctgcccatagggactgagggttagagtagcatggaactgtggtgtgagggatgccaccagctgatgcacttgaaggcattttttagggacatggagatgacggaaataatgaaaggaaactaacagtaaaggcaccacctatgtgctaagcactttacaaacactgagtccccacaatagacacattagtctttacaacagataatagagtattatcccattttacaaatgtggaaactgaggcttagagagtggtggattgcccaaagccacaaagcctcagtgtagtctgtgtctaaacatgtgcagagttctgcggatctaatctctcattctatcccctcaacaatcctgagatgttaagcaacctgtcagacgtcaatcaagactccaaggtcttggctgggcatgataaggccagacgtcctagggagcctgtgcctagaaggtggagctgaggtgtttggctggatgaggacagctgacagtccctctgtctgcagtctgcaggtgaggggagctatggaagtttgaacaactggatggaggctacgacttaaaaggtcagtttgtgaccagaccagagagaggccttgtagtggcccaggttctcactacccacttaggtgtggctgccctgtcaggcagtggcactgattgatgtctgctgtcaataagtgtgcttgcagctgctcccaagcctttctgcaagggcctgattgccatcataccagaggaagcacttggaaggagaatgcatctgattagtcagtaactaatgaacacagggagaaaaaacacttgaaaaattcctagcagggctctgacatttggctttctggcagctagtagagattgtggttaaaagttgttcagatctgggttctaaggttggagagagtgggaggaagtgctgtagaaagggactcaattttgttctgaagtgaccagtaagaattccagttttcagcctcacttggacttatttgattttccagggagtttacagggagagctggagacatattttgccgtggtgagaggtggtagccgtgaggctggtcagcttgagtcagagggagcttcaccttttattagctatgtgatcctgtgcaccttaacctcttggagcctgttttccagtatgtaaaatggggctgatcatccattcaacaactgtttagtgaacacctactatgtgacaagggcagctctaaatgtttggtcctggcgtattggagctgttactccagtgagtgagagattgtagatgagatcacaggtacaaaacacctggcacacagtagacagaagcacagacttcctagcacataggggatagtgatcaaatgaggaaatgaataggaaagtactttctattatatgaagtatgaaacggggcattgagaggaagatcgagggccgggcgcagtggctcacgcctgtaatcccagcactttgggaggccgaggcgggcaaatcacgaggtcagaagattgagaccatcctggctaacacggtgaaaccccgtctctactaaaaatataaaaaattacccaggcgtggtggcaggcacctgtagtcccagctacttgggaggctgaggcaggagaatggtgtgaacccgggaggcggagcttgcagtgagccgagattgcgccactgcactccagcctgggcgacagagcgagactctgtctcaaaaaaaaaaaaaaaaaaaaagaggaagctcgtaggcactgaatgtgggttatcctgaggtgtggatgaagcaggcacctacaccctcatccttaaaatatcacctgtttctcccagcacgttcaccagcctggtttattttttttaaaggcatagtttcaaaacctctggaggtgctgtgtacacccacctgtggcttgttcatgttcccatcagacaatgtcaccattgtgtggctgtggtgccattcacaggcatgacccagtgtctgctgctgcatggggtcccagatcagccttgcacaccacagactggaagaactgggggactttgcccctgagtgtttccctacttggatacagtcctgcaatggtaactcatgttatattggcatttttgtttttgctacagtgagattgttgtgaaactatgtttgctttgtgctttggtgacatgggaaagtgtcagctcccctcttgggtctgttagtcctgagtgacaagtggccagccctgttcccagggtcaggggaaacactgtgatgggtattatgcaatatgcctttccctctctctctgctttttccgcactgctgtagcacttgaccttctgtggtagtggtttctgtgtgggcccctcagtaacagtgtggcatcattaggagccagttattgctttcaaaccccgcgtacttgtcacataacattgggaaagtcactttgcctctttgagcctcagtttcctcatctgtaagatggggaaaataatatctcccacagaggtgggttggaaactgaaggaatcccttgtttgtaaagtgttcacgttgcatggcatcatcttcatggtaattataatcacagctaacctgttgagcccttgccgtgtgtcaggcattggtagattatctcatttcaatctcacagtaaccagaatgggtgatccattttacagatgaggcaactgagtctcagatagggtaattctgggcaagttactaaaactatcaggaaatgcttggagcatgtttggaactaaattatctgactctaagaagtgttctcttaatgatttcaccgtagacatttggcagatggtagttactatcctacataagactggagcaagcattgccccctgcacaggtagatgctcaggcagtgttttcttcatgcaccaaggcacgcatgcagctctaagctacttaacttgatattcagaggcaaagttaggagtagggatagtcccaggatgtggaaaaagatgaaaatcctaattaatgagaagctgtgccactcttgctggtcacttgctctgtgtgagtatccctttgaaacaaaggcttctaggtgggcaggtattagggtttatctttgtttggtggttgtgcaggcaagtaggttactgcagataaaaagagaagaaaccagcagatggctcttcccctccccctgctgccttcttctgggtccagacagggatttataccctttggtataaatgttcatgttagccatattacaaaacatatgtcaagagcaaaggctggcaatacaattcctcatatgctcagatggggaatagagaacccattcacatctcagtgctcctggaacccagctttctaggagtcttacctggctcaagatcagctgagaaccaaagagccttccctgctgtaccctggggcagctcaaaggcgtgtcacaaaatccttctacttatgggttttccttgagggaaaagttccagcatggctcttgcttaaacagtatgtgctcttactttatacagagttttgtttgagacagggtctcgctctgttactcaagctgagtgcagtggtgatcaggggtcactgtagcctcgacctcctgggctcaaacaatcctcctgcctcagcctcttgagtagctggaaccacaggcacatgctaccacacctggctaatttattttattttgagatgcattttcacttttgtcgctcaggctggagtgcaatggcgtgttcttggctcactgtaaccactgcctcccaggttcaagtgattctcctgcctcagcctcccaagtagctgggattatgggtgcctaccaccatgcctggctaatttttgtatttttagtagagaaggggtttcaccatgttggccaggctgttctcaacctcctgacctcaggtgatctgcctaccttggcctcccaaagtgttggatttacaggcgtgagccaccgtgcccagcctatttcttatttttgtagagacagggtttcaccatgttgcctaggttggtcttaaactcctgggctcaagcaatctgactgcttcagcctcccaaagtgctgggattacaggtgtgagccactgtgcccagcttatacagtttctaaagactctggggtctcttaaggaaggtcgagcaactcagtaggtcctaaggacacatccttgtaaacatcaaaacactatcatttatagtgacgtccctggggccggggcctgtcggggactcgggggctaggggaaggataacattagaaatacccaatgtagatgacgggttgatgggtgcagcaaaccaccatggcacatgtatacctatgtaacaaacctgcacgttctacacacatatctgagaacttaaagtattaaaaaaaagacaagaaaagaaaagaaaaagtgcaattgtgttaattaaaaatcagatcattataatctgtttggaaaaaaatcccagtggaattgtttaaaatgtgtggctctcagaagtgtaaaccttcagcaatctagaatgacttattcctccaaaactcagtgttattcatttgaatattaataatggttgtttatttactacatactatgtgccagacactgtgttaaccacttatatgatctcatttaatctgtaaagcaactgtatatcaccactgcacaagttcagaaggacactgatgttcagaagggatatgactccccaagggtcacctagcttataaggcaaagccagagttcaaccctggtccacacctacacctgagactgtagacacttgcctttatgattttgtggttgcagaaagcccacaaatgtcccaagtaatacatcagaagatggcaaggatggggatagaatgatggtcattgccctagaggttgggcatgtggggcactgcagggacattgggcagaaccggacttttctgagaaaccggagagcagaaacccctgttgtgctgtgcagccttgagcaaaagacttgcttctctgtgctctgcctgtttctccagtgtgtagggctggggacaccatttcacctatttgactattgtaaggaggtggtttttaatcccaaggtgggggctacattaaaaggaggatacattaaaccgttaaggagagaggaaagtgggaaaaagccaccagctaatttcggtttcctcaccccatgcagctaaaaggttatgtggacttgtggttgatacctgtggggatgggtatcatactccttgctagatgctgcagatgcaggaatgaatgtgtcaccagcttagctcttgataacaaatggtgcatttcgattttcttaaaattgtgaacaattgaataagcagtgacattctttgtggtgttcaaggacagaatgaacactctactattgttgcaaaatcattttttatactccagagcattcagaactaaaccatttaaccacgtactgctcagtcttagaaatgacattgtgttggctaggtgtggtggctcatgcctgtaatcccagcactttgggaggctgaggagggcgatcacttgaggccaggagtttgagactagccaggccaacatggtgaaaccccatctctaccaaaaatacaaaaattagctgggcatggtggtgcacacctttaatcccagctacttgggaggctgtggcaggagaatcacttgaacccaggagatggaggttgcagtgagccaagatcacacccctgcactccagcctgggagacagagtgagactctgtctcaaaaaaaaaaaaaaaaaaaaaaaaaaaaaaggcattatatgatgacattaccaaagtctagagtgaggcttcctgaattggggccaaacagtagcattccccttacaatcaatccactggaaatgcctcagatgctaaacgactggtttactttaaacattagtctccacactggcatttccttctaagaaatacagtttgctctgtttctcctggagctgctaacctgatgccatctgcctctggatccatcaggctgcctggcatatccatctgcatttatagtttggtagctaaggctccattctagcactttcagtgcagttgttttgcagaatttttcttgggttctttagtgctacccggcttcatttgagggctaattgcagtataaacttagcagtgttattatcccctttggtttaacatggtacaattattatcagtttttgttattacaactaatgattaggttctttacttgaattgatctgtcaaaatgttctcttttggatttcagcctgtttgatgtggaatgatgtggagttataagcaaacaaatgatgcactccttaaaattctgtcaggggtaataaagtgaatcaaaatgaattcactgtttagctgtcttagctttccttccccttttatcttgtcaagcctttgacagcagcttctctccctcacagagcagttctggagcactgagtttttggttagaagggatgggcagaggggtacctctgcaagatggagtgattggagcaagaggatggctggactcattcttgggtactagtgtcaaaggatcctagagactttctcgtgaaatgacttgatgatttagaattggaattggggatgggatggtggttttggtctttcctgctgttctttgtccaatcagtttctactgaaacttcacagctatccacctgggggcaaaccaggatgaagaatcaatgggctcctggggaaaaagcaacagcagccctcaattttccatcattttagggaatgaaagcctttggagaaaacaattctggatagctgaggctcagacaggaagcctgcttgctttaagcccttactcaaaatcttgagcccttactcaaaacgcacattgctccgtttttgctgaattgctggacctgatgaaatctatctttgatgactaaagaaattataagtttatttttcaagggtaccccttggaagaatgattttccttgcatgagctaatgaaacagcaagtgaaggagatggggctgaatttatgtccatgattagcatggcccatgaacactgacttaaaaaataaatctaggtgttttcttgattcacttcaaaaagttgagagctggggacagggagggaagggagaggaaactccagataattaatgatccttgtgaaatggtttctgattaatgagcctgagctatggagtgatttattttccctgctccctgctctttttaatcaataaagagattctgattggaggatttgctgagagcccacatcatgtaagtctcaagtgtaatcagtttcccaagatttgccctttttctccatattcagctctacctggcgaccacttaccagcctcctgcggtgggccagcccctgtgacgcactaccaggagtgcagagatgggtgagtgggagtggaaaggtggtgccagcatacacgttctctacatctgctatatcacaggctgctgaggtttgggtcaggaaattaagagggacttgatgggggacaggcattggaattaagctgggtgagatggcctcaggcagcagaggcacctgggcagaggggatagactgagttcagagagagggaagtgtggggtgtgtccagttttcctgagggttatcgtattattactactgagcatgtggtatgtgtaggtgtatcatttcatttggtccttataacatagactggcagactttctgtgaagagctggtagtcagtacttgaggttttgtgggccacaggtcactcggtcacaactgctcggctttgctttgtagcacgaaagcaaccagagaccataaatggatgagtctgtgtcctgatacctgtcccgaggttgttgaccgcctatttgtttacataaataggtggtcagctagaattggcccgggttgcagtttgccagccgctgccttataatatgtttgatataatccctgttttatggaggataaaaccaaagaacagaaagattagtagaaactaacattgcccagggccaagggccagcttgactagctcagattccaaaggctgcattcttccacacacgctgcctccccttcaaaggctggaggactttctgggacagatggatgataaggctgccttgactgaagtgtgaagagttagcctttattatttttattatttttttaattttaaaaaattgttttaagaagtttaaaaacaggcatgcttaattagcataatactgaatgacagccaatcacaaactgaatttttaaagtgggaagtgtttgctcctggtgtggtgcaccggcctgtaatctgggaatcccagcattctgcgagcccacgcccaggcctaggagggaggatcctttgttctatgagtttcacaagcctaggtagtagagcggaatcccgtctctaccaaggggaggaaggggagggtggggagggaatcaacaatgagctgggcgtgatggcaccatctgtagtcccagctactcgggaggctgaagcaggatgatcatttgagtcagggaagctggctgagttcgaagctgcagtgagctttgattaccccactgcaccccagcctgggagacagagtgagaccttgactcttaaaaacaattttttaagggggggatggtataaaatagatataaaatttaccattttaaccatttttcacatatacaatttagtggcattatgtacattcatgtaacaaatggtatataaccatcaccattatttatctccagaactttttcaacatcccaaaccaaaactctgtacccataaaacttccctttcctccctctgcccagacccttttaacccctattctacttcgtctctatgaatttgattcttgtaggtacctctgtaagtggaaacatgcaatattgtccttttgtatctggcttatttcacttagaattacgttttcaaggttcattcatgttgtaacatgtttcagaatttcattcctttttcaggctggagtgcaatgatgcatgacggctcactgcagccttgacctacagggctcaggtgatccccccacgtcagcctcctcagtagctgtgactatgggcacgtgccatcacacccggctaattttttgtgttttttgtagggagggggtttcaccacattgcccaggatggtcttgaactcctgggctcaagtttgcctttaattcagtgggaagtggggagccattgatgattttttgaacgggtaattagattagagctgcgccctaggaaagttcgtttggcattggtgtgtaggtaaatcaaagttgagagaagagctcttgtttcagaatgagaagttcactttggcagagccgtttccaaccactctatcctgtagaagttcttgtgagtgtacctgatacttgtgtggcctcaccgtggctctataatcgcagtgtgtgtgtatgtgcacttgttgaaataagtttaaccttggcttcttgctgtgttgtgcaaactcacaaagaaacctagttgtagagacagtatgtctattttaaagaaccttaatcatctaagaagggatgagctgaggcacagcatctcatcccactcagctgtgcccttgttgatgttcacttctcactcagctgatgttttaggtgcacgtggctttaaactgtaaacttcatggtccctcccacgtggctgaggaaatccctccagggtttgagagagcagtgtggtgcatcccctagttagggaaggaagccttgctttatataccagcctggccggtttctgacttgtttttctttgacactgtgccatactttgttattccaggtaggggatattccagactcttgaaatttggctgtgagaaggggaagaaatccttgagtcatttgtatcctggagattcagggtggaggctgtggccgattttgttatgtccatttcacgaagctgttaataaaattttttattactaacttttatttactgaacacttagcatgtgccagattctgtgacctttgtatgtatgagctcatttcatcttcataataccaatgatgtaggtatcattatcttgcaaatgacaacacttaggccagagggcacagagggaattgatagcatagaagctaagattaaagcaactctgtcagttccagagcacgcctctttattacccttctccccaattgccttcacttcctgagccccagcatggatcaggacaggcacttccatatagtcccactctgagtcttcacatcgaccttctgaagcaggccttattgtactcattttacaggtgagtaaactgaagcccagaaaagtagagtcacttatccaaaggcattcagatagcaagggaaagatctaggtttgggttttgattacttttaaaatctgggaccgggtgcggtggctcacgcctgtaatcctagcactttgggaggctgaggtgggcagatcacaaggccaggaattagagaccagcctggccaacatggtgaagcctcatctctactaaaaatacaaaaattagccaagcgtggtggcatgcacctgtaatcccagctacttgggaggctgaagcaggagaatttcttgaacccgggaggcggaggttgcagtgagccgagatcacgccactgcactccaggctgggtgacagaacgagactctgtcttgggaaaaaataaataaaaataaaataagataaattctttcactgagaacataatagaggcatgaacctagagtcagtaggaggatgccacggaagggatgaataactcgattaacattcacatttgtattcagagaggcattgcaggatgtcaaagggattgtaaaataggttagtctgggctcaaatcctggctctgccacttatttgtgaccttggacaggttactttacctttctgctcttcagttttctcctctgaaaagtggacacaataataacctctgccacatagaatgaagattgaatgagttaacgtgtgtaaaatgtttatgtcagtgcctggcatgtagtaggcactgtatgttagttggatttattaagctccttctctgcataaggcactctttcaaaagtgctcttgtaggtacttggcatacgtcattaaacaaaacatacccaaatccctactcttgtggagcctacagaaccgggacctgaacccatgtctgcttcttttccttttaatgtttattttccttcctctctccctcttaataattttctttaatgatcttttaaatttcaagttggctattgtcattacaaaggtgatggggtctacttcctgagccttctttgtgcttataaaattgaaaatactcttgctttactggatcgttggtctctgacaactggagagtcacggggaaggagactagcatggatttaaggattggatccttgggctgtgttgtgaaatagaaggtcactgtgggtgcacctttgcagtggaagacagagcttctaggtgggtgggtggtggacaggtgctacagctctcatctcttcaggaaccagaagatgcagctccacctcatcacttcctggtatgaggccctcatggtccccaggtggagtagccagagatgctacctccttagaaggtctctgcttggcaaacctgaccccggctcctgttcccattccaggagtgttgcggggggggggggggcgcgatggggagtggggggggatgaccattgtgtgggattacactgggaaaggcatttggaagaacaggatggagggtgaggatgagaccatatgctgctctgggagtcacatggatcctcggagcaggcctactggttgaggtagaatgatcaccttcatcattttggtggagacatcatgggattagtacttgagcctgttgtcactaaccagttgaggcaggacattctccttttgaccaatcatttgttcctatccatttgaaaaaaagaggtgctgataccctaaggcctacatgttcacatatacactcttctgcaaactcacaagtccatgcatggaacttggcactcaaaatcagaaggttttttgttttgtttttggctttgatggctggggagaaaattttcaggcaagagttttcttgtgcttgttggcctgtttcgaaagaaaatattcttctttcctgaccattctgtgaccaggaagagcaggtcagatatgttccccaagggggtctgttctcctgattccatgggtcagccagtctttgccttctaaaatgctgcacacaacagtgttgtgtttaaatatgttggaatttgcttggttttgttcacagaatcccaacagtgaaaatgatgcctggcttttaaattaaaccgattaaatttgagattattgtgaggccataaataacttcactcacacaagagtaattgaaggggctctgttttcatacttggcttcttttcaagggacccaggctcctgagaactcagaatagctcaatagccctccttaccctgaaatggcccattaagagatgcctgttgggtggtaacctccccatacgttttctcaataaagagaaaaagatgggaaggggtgggggagactttgcttgcatctagagtcgcagcctctcaaagctgcagcctctcaaagccgtctggagcagactgtttagttctgtgtcccctgtctcattcagccctctgcatgttttgaagctttctttagtttttccctgaatcttgacggcagtcctctcaataggctaaggcccagctatggttagctgaatgcgtgatcagcacaatgcactgaattttaatggtgctggctggccctgaaagctcaccaatgggacagtggccactgtgccggcccgagcagctgcctcagactctgagaggggatccgactggcttcctaaagttgcctgtttgctttttttacagatctacacagactgggccaatcattacctagccaaatccggccacaagcgtctcatcagggatctccagcaagatgtgacagatggcgtcctcctggcccagattatccaggttgtgggtaagagcagattttaccttgggggtaatgagttacagtggagccatctcaaaaggccggggtgaggggaacagagcactgaaatctctcagaaggcagctttctgtctcatgtcttgacaatttatttgatttgtgttttgactaagttgtgtgagtaccagcttgattttatgcttttcctgttaaggtcacatacacagaaatatcatcttgattctcttagaagaaaggctggccaaggccagagggaaatgctggtggtttggggaagatgtgttctgcaccacttcttgcctcccattatctttctggctctctcatttccccctttggatggtacttttgtggattactctggaaatatttccaaaaaaaaagtaacgtggggctggtttaatcctgccaactctacttgggtctgacaaatcaaaggctaagactccagagaggattagatggtccgggttaatactaggggaagggaacttgagcagtggaatttgtcatgccttgaccatgtgctgggaggagagagttcctccagtgaaggcacgtgggtggatactggccacagctttgccttgggccttaaggtaaccaccccatgggcctgactgagagcccagagcagacagaggaggcttacaggtcaattggacagcattagcctgattattgttactggtagccttggccaagggagaaggtgcaaggagaggacagggcccagcctctctggcatgttgttgtggaaaagttgcttacccttcaagtgtgagaagtagtctttcatagttggagctctgctcaaatccgtggagtacgtacctgaaaacacagaaggttggccttagctgaaactgttggactactgctgccattcaaagagaaaggagtttgttttccctgttgtcttgtgattgatttcttagactacctgccattgattctcctcttctcctttttcctcctctccctgtattagttttctgttgctgtataacaaattatcacaaacttagccacttaaaacaacatgtctttattatctcacagcttttgtgcatcagaagtctaggcatagcttagctgggtgcctctgcaaggcttcagtcaagctgttgcccagggttgcattctcatctggaggcttaactggggaagggtttgcttctatgttcactcagtttgttggctgaactaattttcttgctgttataagactgtgggccctggcttcttggtggctgtcagctggaggccaccatcacctcctagaagctgctctcagctccttgccacatgggcctcccaatatctgcctgcttcctcaatgccagcatgggagaaagcttctggaacaagtctgctaacaaggtagaatcttacctaacttaacataatcatgggaatggcatcttaccagctttgcaatagtctattggttagaagcaagtcacaggtccctacactcaaaggggacaggatgatacaagggcatgaataccaaagtgcaggcatcattaggggtcgctgtaaagtctgtctgccacattcctttttccaattcttcctcttcctcttactcttcatcattattgtccaaagctcttttaaactatctctcattttctcaaaacccttttgaagtaggtggtattctctccattttacagatgcagaaattgaggcccggtgaagcttagtagtccaatgtcacctgactagtctccatgggaattctaacccaggcagtctgcttctaaagcttctgttctttgctctgctgtattatattactttttactccagagatgcttaacttagtgcggggccttgtcctccttcactttagtaaccacttattgagcaccaatgtgttccagttctgtactccttgctaagaataaataacaaatgtggaaggctgagacctcagaagaaggggtaccttttttttttttctttggtaggatggtcatggaaataccacttgcatctgagctgggttttgaagcccacatcagcagaatcacattatgcatgtgggcctactttgactgagttttgcagctgtgcagagtgtttctacctgaaaacttcccaggttttagcacaggcagcaagagagggaatataaaaaggatcatactgagaggtcttatattcattccagctccatccctcctgactgtgggatcagctgtgctgcctgtttctccatctttaaaatgaggatattcatgcttgttttatctgatcttacagcagtcttatgaaattcaagttaggtatcaaatatgacataagtttgaaatctatggcatgttccagatagcacttggcagcagctacctagaaaggtatgtatggaaggatgatgaggtctcaatatctgtgtcagtatgttgtgatagattagtcatgtctgccttgggctcagaagaggcaaatgggagtatgtatgttgtgcattttctaaacatagtgctatgaaaatgtaagttagcagttttatcattgctcaggatgatgcttccctgaatctattcagatgagatgaacttccctagacagtggcatctttaggcctagggtactggtctgcagttccagagacccaagttagcaccagttgtccaggccacacctgaggccactaaattgcttccctaaaccctccaccctccaacacaggatcgctttgtccagagactcctcaataaggctggatatcagcatgtgactctctcgccagactggctgtgctggggcttggaaactctgctctgtatgtagagaacaggctaaaaggagtgagaagacagcagttgtaggcatctcctgtgtgacttctttcctcagttgtctatcagccagctcagagcatttactcttagattgtcttatgaacacaggtctcttggtgagaggggggagaagcatcttctgactaggatgctgaactattggccatttgaacactttgcttttcaagtccatgctttccgccatacatgcccattaaaagaaaatgtaaaaatatatttgtatgtgtacacatatttaatatacacatatgtatgtatatatagatatccatatatctatatatacatacataaaattttctacataaaattttatatatatctacataaaattttctacataaaattttatatatatctacataaaattttcccagaattggaatcttactgacttcatcttatactggacagaattctagtggctatacttgttctttgactggcaagctcctacttattcttgaaaagtgagtttctctttgagacctttcctagctccccgacacagaaccagagggacctccctctatcatcccaccagctgctgtcttgggcctgggtcttagttgtcttcctttctgggttcccaacatttagcatggtgccttgcatgcagtgatgttcaggaaaagttgagaggattagggataagaattttattcactaccagcctgggttggattgtttccaataggtggcccgaatgtttccccttctcaacatttagtactccactaaacattcctctaaattgtatgtcacacctttctactttctagggatctaccacagctctcaactgtcaggtttggaaaggacctttaaaagctccgatctgggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctgctcgggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaagctccgatctgatgaatgaattgcttctataaaaagtagtcaacaacctctattaattacttcctgtgatgggcagcttactaccttttcaggcactagttctaatggtgaagagttggaatccttcaaaagctcttttcttagattcagactgctataacaaaataccagactgagtggcatataaacaaaagacatttatttcttatgattctggaggctggaagtcaaagatcaaggtgctggcagattctatgtcttgggagggcccacttcctcatttgcagacagccatcttttcaccgtgtccttccatggtggaaggcgtgatccagctctcttgggcctgttttataaggaaactaatcctgttcatgagatctttaccctcatgacctaattatctcccaaaggccccatctccaaacaccattacattagggattaaacctgaatatatgaattttgggaggacacaaacattcagaccacagcagctcttcttttattaagtcctccccttggtagtgtcattccctgtagggctacaaagaataatccaatctggggacagtgtgaacatcaaaatcaattgaggacaacagtggattatagccactaaatagaataggaatccacaagcctataataataaatagatacatttaaaaatagatatatcaatggaggagaagagagggctggactctacaggagaacgctgactgatagagggagttgcagccttctggtgaatgggagttaaggcaagaatcatcaacggatgctgaaatctagagggggaaatttgaggaggagcaggattttcgcatagtctcaaaatatctctctattgattgcttattagctgcaaggggaaacaaagtaagcactaattggagtatccagatcacatcatgactaggtgatcaaaattacatcactggtgagggacagatggacgtcatgtgcttcctgaggtgataccctgagaagaacacaacatcagttatgctatatgccagtcagggatggaaaacctgaaactaatcataaggaatctcagacaaacccaaattgtggaacattctattaaaaaaaaaaactgggctacattgttcaaaaatgtgaatgctgtggaagacaaaggctgagaaactgttccaggatgaaggagactaaagagatgtgacagctaaatgtactacgtgatcctgaactgcatcctgtgcagagcaatcacatggtctaaaggacattttttactcaattggcaaaactggaatgttggaattaaatcagtgttaaattgccagaatttatagctgcactatggaagacaatatactagttctttggaaataaacactaagcataagaagcaaagggcataatctatgtggcttactctgaaatggctcagaagaaagatgatatgtgtgccttacagataaaggaggggaggagagggagaaaggaaaggagaatggatgatgtatgggggaattctctatactattcctgtgacttttctgtaagtttgaagttgtatcaaaatgaaaagttaaaaagaaaacatatctaaatgaaggcctatcaaaatctgtaggcagcacgattgtgccttttaagggacagccgctttctaggcccaggaggagtgtagtgatgatggcatggttgaggacccactccatcgtgggtcaggtgctcagacccgacctatgatggagtggggatggtgggagggtgtcaatcacagaaaggttcctcaaggaacttacctataagccaagacttcagactttattaaagtgagacaggcaaagcagtcagggagggcattcccagcagagaaaatagtgtgtagagaggagaggagagccagagggccagcaaggcaaagtcgggcagggccaccaggtataaggcaatgaattctgggctttagcctaagaacaagggccagtggttgaagagttgatttttcaggctgagaagtaacatctgatgtgtaacttcaaggaaaaacttaaatggtttttgttttgttttattttgagacagggtctcactctgtcacccaggctggagtgcagtgttacgatcttggctcactgaggcctctgcctcccgggttcaagcaattctcccacctcagcctcccgagtagctgcgattgtaggcatacaccaccatgcccagctaatttttgtatttttagtagagacagggttttgccatattggctaggctggtctggaactcctggcctcaagtgatctgcccacctcggcctcccaaagtgctgggattataggtgtgagccacatgcctggccttaaatgcttttcacatgcgctgttcttaagtcttcatctatcccagacacccctggagctgggcttcctagatagtgggattgtttgcgacttttctgccatcatcttctataaggcagaagaaagtgggccttttgctgctgctctttaggagccttcctttggtggctaaggttggatctgtgtgttcaacgtcttgttagtgtgattatcttcttgagtcatgagcttccccaagttggctgttgcctgccagcccatcacagtggcatctctgtgaattattaagaaggtttaagaggccaggataaacagcatgaatcaagagagagacaggcctccctcctttgcttacgttgctgtcacacagggaggatgccagaagaggttggagcaaggaaagcagggagcgagagagaaggggtgggagaaaaggggataagagttgagagaggaaggaaaagatgaacaaaggaggactggagaaaaagggagcaaagagagagagagaatttcttcttagaagtgggaagacctgatagcagcttcttttccaccaccatttgggctgcctctgaacacaaccaggaaattcagacaacatgtaggactatcccttctttctgttgatgatctactaccattatgtgaccctgggtaagtcatttacctttctggggagccagtttttgtctcttcccattggcagggttgttaactgccagggatgataagtgcatagatgcacaagctatgttgaaatgttctgaatcctttaatgaagtcttttgaaaagtaataagcttgatatcactgttcttattttaaaagtgcactgatgctttccagtcactaactagtcaccttgcatgcaggcaggttactgcattagtggggctaagaaagtcttgaatacgctgggataaataaattaccattggcacttaaggatgccagttttaatcacagatgaggactttggggataagtgcctttgtttctttgattatctgcttttgggatgcagccaaagaccccctgccctgagttactaaattcagctttgaagaccaagctcttccttcttaccagcagaatcagagctgctattagcactctaattatttatgacaaccataggaattcctgggaatttaagtaaaggagaagtatttcaagtatatgaaactggaaactaggaggcccaaaactcattttgtaattttattaattatttattttgagattggattagtcatttgattcatctcttcccgtgtactctttagagtggttatatttaggctttaccccatcagtttattttgacttttgtaaaatggaagtattaggcttgtaagagccatgatatttaaattcaaagagcacctgactgggtttaggtgacagaccatgaaaaggaattagatgagaaattagaccaagccctttggtttcattattcaggtggcatataaagaatctttaaagtgtcccaaatgacttattaggatcacagttatccgtctttcactgtaatgagcactaatgacctaatgctgaactgggtattgatcagaatccaatgacttatgactttggccatcatgagtatccatttggaagacaccttgactggccttgattctcaaaagctgcatatttattctctccaatgttgagtgtcaaaatccaaggtcagagctcatgcctgccataatttcccaggtatggaagagtgccatctgtcaagtgtttggtttttttggactttagtatatacatctgtattataaatggaaggatagctgcctgaaaataggcagctattcttgattcatctcaatgttcaagaatcaagatttcttgattcattgagatattcagaagacttatttcttagttccactcaacaagtatttattgtgtggctcctgtgtgccagacactgtgctaagctctggggtgactgtagaaaacaaagcagataagaatctctattcttatgaagtttacaagctagcaatatattctggctcattatattttctaataaacagaagaacaaacatctatgagttattccattcagtgggcatcttgtttgtgcttttcatggcacctcttttgggagcaaggctttctacaatgcctatcctagtgttcttatattaagaggagttgagaaaatgcaattagatctctgaagattgggattttcccaggtgggtcataaaccttaacatctattacttctggcaggttctaaaaaaaaggtgtagattagactgaatatatactaaccagtctgtcttatggtaattagatttttaaacaattttctgccactagcttgcttcttaattttcacttgtctctcaagatagaaacagagaaaaaatgaattcaatttgagataatgattcaggtttctaaaatcttggaggcttgggacactttgattctattatctttttcagacagtttccaatggcttttctctttttggaagttttaggtatcatatttattaaaatatgatatgattttatttggggaattcaattttgtgagcagttattgagctcaaaggatacagatgtgaaaggtaaactatacacgtctgctaggctctcacagcatattttggggaaacaagaaaaggaggaattatgtattggatgattaagaacaaaacagaggcaggtacagggtgctgtgaggacagaggcctgagtgtatctttcccttctgtgagtgaggacatgggattgcagagggagcatataaaggtttcaagaggaagctaacccttagtcctttactgtggagccctagctgagtttccaaactgagacggagatatcaaaaggacaatttttatatacaatacgtattattgggttcatgatactaccatttagagaatacttactacgtgttgggcaccgtgctaagcattttactggcatcatctaattctaattgcttctcttgtgaagcaggtagtattaactgtgttttatagatgaggaaactgtgacccaaagaggtcgagtgacatgcctgatgtcacacgctaagaagctctgcagctggaattcacgctaacgtatctttgcctccaaagtcagtgttctaaccactatgctacggcctttcttgtgctgctgtattctcaaacacagtctctccatagatatcttggactgtgttatgccagggactcctccatacttacgatgaactgcattcacccagggaagctgggccagtcctcctttgtattagtacttgatttcctgtgaatgcaatgcaacctctttccatcacttctctaagtagctggacacacatatgtgtgtcccttgatctaatttggacttactgtgtggcgttggtcaagtcacatagtgagaaagtgatgaagtctcactttctcattttccccatttgccactgctttgggaatagttattaggacaaacaaaagcaatattaatctggccaaagatggagtgagatgctttcatttgtggcttttttctctgggagctgagttgtagctggactgatccactctgaactattccgtcttttgtgacggttgtatttgcctttccaagagcctaaagcacaatcacagctagctcactctctttcccagtctccaagcatttccacgatgccccttcactccaagactgtcatcgatgcagttgtctctgttttagatgacgaccttgccccagctgtccctggaggacggcagctcgatgagtaagtcctgaagcttgctagatgtgtctcagtatttcacatgcctgcactgattggacaaaccctggtatgggccttaggacttggttgcctcaagtgtcctgaacatcactactgaaagtgtctctctggtgatttatttttctgacttgtgtttcctttttcagcaaatgaaaagattgaagacatcaatggctgtccgaagaacagatcccaaatggtaagtggtgcataggtagtaaatgtttgagttctgtcagcaagccctgcctctaagtgatattgaccatcttgaaaacattcataccagatgctttactccaggggattatattaataaactcacagctatttccaagtagctgtgttctgcttttctgacatttgttggcatttattgaaaaatggctatgatttttatgtagattgtgagacagttaaagtgaaatattgtccttgttcttagacacaaattatgcagaactggtacaaacatatacatgtttagtacttgaactgctgtggctcgttctgcttcctcaaagacccacatcaatatgtgtttgtgtatggagctgaggcacggatgaagtgatggtatcttactaatcagaaactggagcatgtggtcagattgcctttaaaggttggaatgatgtgaaatcagaactgtgacaggaaatgtgaaatgtgcagtcacatctgaagcttttcaacataacctttgcaagtgatattctctctggcatgatgcatttaagttctgatattatagctttatacataacccccaaaactaatcttttaaaaatctgttctttttcttattgcatgtcctgcacataatctttgaattaaaatttatcgtcattgttgagttcagaaaacattggcttagtttttcacttcaaaacaaatttcaagcatgaatatttacaaaaaaaagtatattttcagagtctgttaagataacactaataacctatttaaaacatgaaggtggcaacttaaggacaactattttttgctggatgttcatttgcttccagaaatctaaaaaaaaaaaaaaaaaagcttaatttgcttctgtaaccccatcctacctcctttgagtaggcacagtttgataggtctcatttcagaataaaccaaagtgattggcattccttgggcttactgtttagttttctgaattgttatcccagtgacttgggcaaataggcagccattttagttggctttttttaatgcacattttgaatataaagatgtcagtgtatgtatggaaggggagtcattttccagtttatattctgaaacaagtttttgttgttgttgttccactgaaggttttctttctttttgatccaaagaccaaccacttcttacataggaaagtccccaggctgacatctcatggctgctttgacttttggaaaagctgggctgctatttttgctgcagctactgcagctgtctagggtattaataattgagaaaatttggatgatagaagacttaattttagtgcaggcatgctgcacatgtagtcctatcttcatatgaaacagatgcattatttccctccaggatagatactgatgcaattgccccaggccattataatgtgtgtgtagaactggtatgtggaaattgtcaaccttttattctatttggtgcacctctattctaagcaccttctattggaggttttgcgtgttgttagagtctacttccaagcttatacagattgagtagccctaatctgaaatatctgggaccagaaatgttttggattttggaatatttacattatacttacagcatcccaaatctgaaaatccaaagtgtttcactgagcacttcccttgagcctcatgtcatgctcaaaaagttttggattttggcatattttagattttagatttttagatttgagatgttcaacctgtaatattgtcatttcagattcttctttgcaaatttatttccatatgcaaataagttacttataaatactaccatagcaccaatgcagtgttgcagtttctctataactctttcagccatgccagtgctatatttttttgtttttgtttttgtgtgtgtgaactgtgtgtttttttttttttttagaacacaagaatataaaatcctataattgtctgtgataattagttccagcttaggggtagggaggcagacacagtcttgtggtaagcctagcagagagtagttcagcgtacaggatgtgagtccaggaaaatgtgaaaacttctgccacagtcattctattctgtaggaaatgaataggatgatgagaaggacaataggatcattgttcttgcccctacatcacaaaacaatgacaagttcataaggcagaactcactagatcacacaggaagttctttcgatagacaggcatggatgattttctggctaataggacacctgtgtgcacacaagcatatatagagttaaagcacttttgctcatgggaagtataatttgagaagatggcatagggtgtgagccaccatttctagattgctaggtggttaacctcccaattagactttatctgggtggccaataataaacatttgttgttcgctaaatattgcctgtttggaggataccaaaggagaagatatgtagaaagcatggcagaaggaagatgacacacaatgagatgagaacttgggaagtgtatcctgttaggagggtaatgggctctgctaggaaaaaaaaataatcagcatagagttaatgcggtcactccctaagaaaacagatagagcacctttagggccctttaataatagagacaaaaggagttttatttcagagcaggaatggagtgggtgctattccagttttcagtgggtcagtttgtatcctcagctcaagagtaggttaggagcatgagctttgtaggaggagcaagccctggaagaaggcaccttttcctccctcccttcactcttcctaacccactaggctgcccagctgctctgttctctgctgtaactcctgctgtcttcccagaggatagggaagtaaaagcagacatttgtggaatatgacctagaggattccaggggcagcagtgcataatcataatgggcttggcattgtgtacttttagactgtcaatcagcaagcagtcacagagtgcctactaatgtgagatgctggactaggccaagctgaatacacaggtgaccaagatgtgatccctgccctcaaagaactcagataagtgggcaagagaccagagaacaattagaagaatagactattgcagctgctcccacagacacctgtgcatggcactgtggagacccattctacccccagggcaaggaaggttcctaaataacttctaaagggtgagtcttgaaaggtcagagagttcaccacaagagatgatgggtggaagaggattccaagtggagacagccaggcatggaacccatttctggagaatgggtttacttgaggaaatcatggatcccacagaggaaggttttacaaacaatcatccattgattgtaccaaattgccatgaactgtgtctggtgaggctcttctagcctctgggcagcatcaactccttgtcctgttgtacctggggtgaaaggaggggcatggaagagcccacagtacaacagactcataggcacagaggtcttttcagacctgggacaagccttgtgcatgcttcatcacacagattcctgcatatgggggagaaacctcagaacaaagttttctaaaggaaaaaattcgaggtcatcaattcctgtggacagaagttcagccatgaaatttgggaaatggaaacacaacccggttggaaacggctgttaatatttttatattagcactaatacgcatctacacagtgctttaaggcttatgagcccatcacacattcagtcctcctgactctgctgtgggctggcataacactcacaccttttgggtgagaaacggagatgctctccccaggactcaagcctgatgcttttccatcagcatttgtaaccctcagtgccgccctcctcttggccctggtaaaatggcaccaggtctgtaacccaaaggcagagaggcacagcagtggcttccctttcctggagcaagcccagccttggcttgtttttaaggagcgctttgccctgtttcagtctgacccagatgcttttggggccaaatccttggagatggagctttagaaacaacactcccaccccattccctctcccccaccaaattcatccccttggcccttaaataagtttgcgtgtgtgcgtcagagctggttaaaatgttttgtctatttaacattgccatggcaaccaaggggcatctctttggctttcaagtggtgtgttcagcagagttatctgttagtgtggaaggaaaaacattgcttggaggttagccagtgggtgctggggcggccctgcttcccaatttgaactcactgtactcaggacattgggggcattggctcactttggagcctgggaatagccagtggcagggggtggttttcttttttcatcattattattttaagcagcttggctgtctgttgttgattaggagaagtgcaaagttagggaggcttgcttgccttttcagcaaaaaagccccaggcctgctttcccctttagctgatcttggacctggggtcagctgagcctcccagcgctgagcccctgcttcctcctgggctcttcaaggagtcctcctgccttcttccctcagtgcatctagacggagggccagcctgagcttggggaccagccaggccaggtttctaattccttttctgctattctgcagccttgagctaattacttgactctttgaagcctcatatttcctgttctatgaagtggggttgataataatacatacctcataaagatttcatgaagactaatgaggcaatgaaaatgataataatggataatattaattaaagtgataaaatataaccaaagcttacagtgtttgtcttgtgccaagcaccattctaagtgctttacaaatacagcatgtccccttagttcatcctcccaacagccctttgatgcgggtgatcttattatccctattctcctggcatataatcagcactcagtatatggcagttactacgataatgaagatttctttcagtgatcattcatgttttgggggacatagaaccttttggaaatctgagaacccttcagaaatcttctagctctctcctccccaaattgcacttatcccagaattttgcatacaacctgagcagatcatgaaccccagaggccagctcatgtatgccctggggctccatagactccaggtttggtgcccctgctgcatagagcacagcccttcttctcaccctgtcctttcagggagctctatggaaaatgccagcactggagttcctaagacagtaggaatctgcacttaggcacagagaagggccaggcagtgattttctaacttctattccataagcagaacccctcattttcccaaataaaagctgtggaaccccatatatgagtgataaaagctgctataagtaggggtaggtagcccaggacagggccaccatagctgccccttgcaggaggccagcacctggggagatgcagcgggatgtagcctaggaaggaacatggcagtgtcaggtttcagctctgctcttggctccagccctcctttctctggtcctcctcagtctcttttctgtgaagtcggattaggtcttacctctgacctctgcaaggcatcacagctgagagcaagggctgggaaggccaactgcttgtaacccaggtgtgtcccttagtctctaagggagccagttcctataacagaggtagtaacagtatttgcctcatggggttgttttaaggcttccatgagacaatctacatgaagtgctggcacgttgctggccacagagttgctggcctcagtagatgttagctcttttgatgatttttcaagggacttaagtatttgttaaaaaacagacatgcctcgggaacagccaactctgcttttgggtgggggcttgtttagtggggtttgaattcatttgtatgcctacatctctctgaatgatagcactggactcaaaggaaacccctgagagatctcatgtcacagaacactgtggtcagtctcgctcagtcccatcataagtggccctggataatccacttggccttagcacttcacttccttctgtgagaaatgtggaagagaacaacacctcgcagggttaccatgagattttaatgagctaacatttattgatcactcactatgcaccagactatgtgctgagagcctactcaatcactcaaaacagccctatgataaagatgcagttattgtctatattttgtacatggggactgaggatttaaaagggtgctcgtggtcccagattctttacctagggagaggcagagttggagctcgaacccaagtctattttcagagatatggtgtttacctctgtgacagagaaggggtatcataaaaatagtctccacctcaccaagccgtgttctccttagttttcatctgcagctacagcagaaccagttaggtttagctgagagttagcaaaaagggaggagatggaacatttctggaaagggcctgagttgacctgctgatggcaacatgaaagctgaaacaggggcaggtggccccttgtgaaaggcagctccttgaattggcctcgaagagccctggcgccaggtacctctctggctacattctctccagagcctcctgggccaggaaaaggccatctgcagtgggatcagatttccaggcccagtgaccttgagccctcccaacagctgccagaaagccggccacatgcctggggagtgtctgagatccttgggcagctgagttgcctcttccctgggccctgggcctatttttacacagctctaagggcacacacatgttgcagaaccaagaaggaatgaagaaaagtccataggccacttagaatttaaagcaaagtagaaagagctcagggccaagatcagcaggaagcatccactgcttcccacccagggcagcatatacacactatcttatgtgttggccatcgttcattgtctttcaaaggtggcaacaacctccacgtctgtctgtctcttcagtcatgcctgtttaaaactgtcattgccttcccatttccctctccatactctttagcacggaatagaagatccttcaagatctgattaccatcctctcctgccacttggccactcaaactctacaccccagcgagaccagataccttgtagtatgccaaagaggccgtgtattttcatgcctttgtactttggtaatatacaaagtacttatttacagataaagtactgtccagtctgccacaggactgatctcccgcttgccccttcctgggcagtgtgacctttaatattcaggtcacttgtttcctcaaagtgttgacataatgaggtgcctatcatcttttgtgtccccaagtgtcctgtgcctgcttttaacataatacactctcttgtggttgtctgtttactcatcttcttgaaggaaataccatgtctttcacttgagtatcctaagcgtctgtcattttggtgactgggcctgtagtcagcatttagtaaatacaggatgggtagatggacagacggaaagaccagggagggagctggcctgaatgtgtgtgtgtgtagctggaggattctaacataccattattctgatttcattatctacagctgagcagtgctttgagcactcagtattaatttggaagttcctaataggatttaagaaatagatatgtagtgctgttctagaagtgtctttccctaattcttttcttcctcagtttatccagaggacccaaatagaacattgtaattactctcaggacttgtggttaatttttagtttattgagttttttgtgttgcttgaggtgagcatatttaattaagcaccctcacaaccaccagtttattaatgttgataacaaaaatgatgataaggtactgttctaagtgccttccatgttttaactcattttattctcataaccatcctatagaatgaggaatatattttatccattccattaaaaagaatggagaacttagaccttgatgccatttaatgtgctctgccaggggccagctgtgggttgtgataaagaacctctcattctttcccctcacacagtagcacctttgtccctgactttccaccatgcttttatttaacaaggtatagcaaacacttagagtaggtactggtttagatattttatctgtattgactgattttatcttcctaaaactctatgagagcatatacaattgtgattgccattttatagatgaggaaacagagacagagagcagttgagtaacttgcccaaggtcacacagctagtaagtggcaagctggggtttgtttgctggaagcctggctcgagagtctactcccttaactgttttgctattctacatgtaaaggaattgattaaagaagaaaaaaaagactcactatgacatggaaaggcagacattccatttgtaaccctagcccctcatctaggcataggcagaggctcaggatgagacattctgttttgggaaggagatgtgggataagaagaataagcatgggctctgggatcaggctgacctaggttccacacacggggtatgtgtgctgggccagttaattgaatttctctgagtctgtcttctcatctggaaaaggataatgatggaagctaccttctagggttgttgtgatgggggtataaaaggcacctggtctcatcctggctcacagttaatgcaagtgagaaggtcattccctgccctgtttacaagtcacatatttcctaactatggtacatcaaaagattttttcctattcaaaaagtacgccctcagtggggtagctgaacagtgtcaacccatccccaacaatgttcacatcctaatccccagaacctgtgaatatgttatcttacctgatgagagactttccaaatgcgattaaggattttgagatgggataatgatcctggattatctgggcaggcccaatgtgattacaagcattcttataagacagaggcaggaaggtgagagagatgtgacaatggaagtaaagttggagagagagattggaagatgctaagttgcaggctttgaaggtggaagaaggggccatgagccaaggaatgcaggtggcctccacaagctggaaaaggtaaaggaaacagattctcctctagagcttccagaatggatgcagccctgccaaatcctaggttttagcccactgagactgattttggacttctgacctccagaactgtagataatacatctgtattgttttaagccactaagtttgtggttaatttgttgcagcagcaataggaaactaatacactctgggattcatgcaaaataactcttgctgtatcagagagtaagctatttgggttttatagcacaggctcattttgctgtaaatgtgggttccttggatttctgagtttactggaaggtgcctctattgttagaacccttcagaatggagcttgctgcatcagtacattcagagcacgtcactgtagggaagcatgtggaggacagagacccacagttttttatttctagtactgtgtccacattgtgggccgatatacatactaagctgtcatgggagaggcaagtgcatttcatctcagtaattagaagtgaatattgcatcttctggacctctttgccaatgtaaactcacaaataggtactttgtccccacaactaacatatgtttgtcttgttaattaacataacatttaagcaaatgttaggaatttaccatattttatatgctattgaataacatcaaagctttgtaatgtgaatagtttttttaaaaatctctttcagttcaataaaaatatccatattctcagcacctggcacaggcctaggtatgttagaagtgctcagctaatttttctcagatgagaaagctaaacaataagtggtccaacaatccaggagtttcacagagaatggagtgatgtgacatatcaaattttaatattttgagcgcactgtgtaagtttaagtgctctcaagaaatgtgggattcagtctcttctctcacaattttatattttaactcagttctaaaggtatatgaaaagacaccaaaataacagattatttttattaataagggaaatggtgtttgggttggtaaagcctccaatagccgtgttcaaactttatatgtgagaggcacctggagagattattaaaacagattgctggaccccatccccagagtttctgatttggtatgcctagggaggagctggggaatttgcatttttgacagtctcctgggtgctgatcatgttactgctctggtgaccacactttgccaagcatgacacattgtctctgagttaagtaacaaagcctctttgctgggatatgactgagcaaacatgcatttaaatatatattagtctgtaaagttgtttccagttttaaaagttaataggagggaatccttttgctttttggaaaggttaggatgccttcaagctagtccaacccgtggcccacaggccacctgcagcccaggatggctttgaatgagcctcaacacaaagttgtaaactctcttaaaacatcatgagatcttttttttgtgtgacttttttaaagctcatcagctattgttagtgtattttttgtgtggccctagacaattcttctttttgcaatgtggcccagggaagtcaaaagtttgggcattcctgccttgtacattcttttttcttagaactattatatgttccaaattgatatgatttgaactgtgcatgtggtcatgatctggttggagtttgagatgccttctctaccctcttccagctcacttaacctctgtaacttttttttttttttccactgaacgtctggggtgataattctttaggacactgggcttaaatgcctgtgtccccactagacattaacttctttgaggacagtagtggcatctgtccatttgctcacactgcttagcaacctggtagatgctcactcagtgaatgtttaatgaagaaattcccaacacacctgcattgggactgatgtgttgtgagtggcaacatgttgtactcaggaaggttaaagaatgtagcaaatgtgaggctgaccgaggttggggctgggggaagggaaacatagctgtagatctgagctgaaagagaaattggatggtgatttataaccgtgtggattgtggtttatataaaagccatctgggcctcatgcttggatccacctccctgcatatgtcttcatggagttcttatgtttcagcctagcatcaaagaggtgtttttttgtatatgtgttgtttttttaaaaatttgccgtgaagtggaacttagcagggaaatcctgtttggacgttgtaaggcatggttagcctatggcatctgcatgttggaaactggtcaggtcagtggacaagtgccagtgtgctcacttcagagagtagagaatggtggccaaaaagctaagttgaggtgcttttaaaacaaaaactgaacagatgccaacagttagataaaaatcaatatatttcattaaaattgatcttctgtggattggcacgcaacaggcaaaaaattggctgtaactgggtaggagctgccccctttgggtgggtgtgggctgtttgtcacaatctccaccattccctattgtcttatacctaacccgttttactcatttgttacctgcctatccccctgcacacatttgacgtttttgatccctaaatgatgatattctcataagtttcctgagcttcctcaggaatcctaagcactggcatgtggtagcttgagaggcctataaatgtttatattgacttaaattattcttgctcctgaagatttagaacctaaatatcttccctaagaaacttacttcttcctctgtgaagtgtcctttttaaaatgtaaaggttagatttggtttgcatggactgattacttattgccttgttgtactgctgaaatcagagggcaggaaaaatgaccaggcaaggtggtcatgtttctccccagctctggcaaagcacttgctgtttggttgttaatgccccatgtttgtatagggcttcatagcttacagaacacttcctattgtgttcaaattctaactctgatgtttaatagctgcggcttaggaaggctcttaaacactctgtgcctccatttccccatctgaaaaatgataataatatctaccttatctagtggtggattaaaaaaataaaaattaactgaaataataatgtatgggacagaatttagcgcagtgcttcaggtttcataagaatgcaaatactagtttctggcaaggtctctgtatggctttcaagaaaggaataattatccccattttactgaaggaaaaactgaagcttagggaaattgagtaccttgcccagaggtggccaaggagccctgagaaatccacaattccctagactttccacctggtcattcgaaatccttgattcccctgtctacccttgaaatctcctcttagtaatagctccagtaatgatgaaactttgagatgagttgacttttcctatttcagtagctttcttgggtgagagggctcccacattggtgggaacatggtaccagttacacagagttggatgtgagggcagaacctgtccacagtgtcgtctcgtatactttcccctgaaggaatatgaaggcaagaagaaagaggcatgcattccgggtttccactgagggactacttgtgcatgcttctagtgggaggctttctgaaatgagtcaacttggaattaaagtattcctcaggcccccttctgtctctccaaggagattgtacagaagaaaccctaaccagagcaaagggcctttcatggttagcctttggatagggtgtttcttcctacttggtcttttcctctacatacattgcataaccagtcttgtgagactcctttaagaaggatttgccgggatttgatttgagtttcagaattcattggttgcctccttttatgaatgattatcaagtgctctctctttatgatcacccagcagtttaattttagtccttggggtgggtggagggagacttcctgatatgtggatatgtagatagaaccatatgaaatgaccaatatttaaccattttttacctacaaaaatggcaattttatctagttcaaccaaagatttggcaaagatgtaaacagtaacagaggttagcattctatgacaacttaaaaattatcattctttcttcacaggtgcatttggtatcttgtggccttggaaagctcagggatgtcctgtaatggaatccttccttgtctagtttgttctcctctttcagtggattttgaccatgcctctgacattgtggctatggcagcaggcagtatgcagagtggagaattagttattatatgcttaattatttttaatttcataattcctaattggttggcatgtagctctttgcctttatcacagactttagaatttgaaactgttggccaaatcgtttcttagtttaaaatattttgtgtattccttgcaaaattccccaagttatatattcacgatcatcagtgatctaggattcaggtgcaactccttagccatgcctacaactagcttttgaaataaaaaatagattgaggtaatgtatgtggacgtttctagtattgtgcctggcatataataatcacccactgattgctggcagaatttgaaattagagtggaaacaatggtgatttggggttagatttctcatagacattaacacaatagggtgttctataaaggcagagaatagcggacccatggccttcattctagccatcatcagagtaggtgagcaaagtcctgcaggattctgaattgagcattaatgcattcaaaggtatttgcttggctttgtttcctgcttatggatgccaccaggacaggtcttacatttaagtacacactatcgttggaatttcaggaaatgcatggattgactgttcgtgaacaaccagaagaaccataagctgccgatagtggcaaattggctgaggcacaaagcacaaagctgacttacacaggctggtgtgagggaactggtaccaagctgaggaatgagtttcactcttggccttcctctacagattattccattaccatattcctttatatctacttgttttgtgggtataacaatgtggtctagtgcttcttccaaaactgaagattcactgcactctagagacatatctactcctgaatttcaaggatctgatgtcttatttaattttgcatttatattctgctacctcttgaagattctatggtggcttatgggtttaagcatgtaatatggcaaagatgccaaagaaacaatccagacctctttaaaagagcatggtgagtaagtgtcaggcttttgagtaggtgccttgataagaataagttgtcccttaatatatttgtgactgtatgtttagtggagtgattgtttacttaaagtcaactcttgcccaggagactagctgctccttgagggaaggaccacactgtcttgtctgcctgcgttttctgcccattgaataggactgagaagagagtagatgctcaatctgtattttcaaggaatgaatgagactgtcaggttccaggtaattgcactgggtgaaatctccaacaagtgtctgtagtcccactctgtctacctctgttgtctgtcttaggggactggaagtcaggatttttttcttaaagtttgagtccaagtttatgtcctcttctgtgggtaaaaccaatgttttctgcaaaaacgacttgatttttaaaaagtagaattgatatatgtatacattgtataatgatttccataatcaaagtaattgatacttcagttgccatgcatgctataccttagatctctagaacttgctcattttttaattattattattttttgagacagtttcactctgtcgcccaggctagagtgcagtggcatgatcttggctcactgcaagctccacctcccgggttcatgccattctcctgcctcagcctcccaagtcgctgggactacaggcacccgccaccatgcccggctaattttttgtatttttagtagagatgggttttcaccgtgttagccaggatggtctcgatctcctgaccttgtgatccacctgccttggcctcccaaagtgctgggattaaaggcgtgagccaccacgcccggccagaacttgttcattttatgactgaaagttgatgccttttggctaccatctctccatttcccccatccaccagcccctggtaaaccactgttctgctctgtgcttctatgaattcaactttttattatctcacgtataaacaagatcatgcaggacttgtctttctgtacctagattatttcacctagcataatgtccttcaggcccatccatgttgttgcagatggcaggatttccctcctttattatggctgaataatattttattgtgtgcatatgccacattttctgtatccatttatcctttgatgcgttgcacacttaggttattttcatatcctggtaattgtgaatagtgctgcagtgaacatgagggtacagatatctctttgaaataccaatttcctttccttttgtcaatgggagttcttatggtagttctatttttaatattttgaggaacttccatactgtttttcataatggactcttgactctccttagccaaaactatttgcctaaaaggtcttagggtttctcatgcaactcaatagaagagactttgaccacaaagttttttggatagatagttctggttctggcaggctaaaaatgaatgctagtgacaaattacatattcggagaaaggctgtactagtgtcacataatttaacaagtctcagagtgtctcacacttcaaaatgatctttcactttcaggaaatgccgctggtatgaaaattctgccattatgaaattacgtgaagaatgagcccttttagagctctgggtatgtgaagttccagatcattgacatatatccacccacccaatcctctcagtaatggtgggagatagatatcagcatttcatgttacagatgacaaatctaaggcttgaagcagttaataattttcttagagtcttgtgggcatctgtcagggagccagaaccagatatggaggagtccaaaatcatattctcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagtatgctgccttcaagcttctgtttaacaaagcacatcttgcaccgcccttaatccatttaaccctgagtggacacagcacatgtttcacagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccatcgtcatcatggcccgttctcaatgagctgttgagtacacctcccagacggggtggtggccgggcagaggggctcctcacttcccagtaggggtggccgggcagaggcgcccctcacctcccggaccgggcggctggccgggtggggggctgacccccccacctccctcccggacggggcggctggccgggcggggggctgaccacccccaactccctcccggacggggcggctggccgggcggggggctgacccccccacctccctcccggacggggcggctggccgggcagaggggctcctcacttcccagtaggggcggccgggcagaggtgcccctcacctcccggatggggcggctggccaggcggggggctgaccccccctccctcccggatggggcggctggccaggcggggggctgaccccccccaactccctcctggacggggcggctggccgggcagaggggctcctcacttcccagtaggggcggccgggcagaggcgcccctcacctcccggacggggcggctggccaggcggggggctgaccccccacctccctcccagacggggtggctgccgggcggagacgctcctcacttcccagacggggtggctgccgggcagaggggctcctcacttctcagacggggcggctgccgggcggaggggctcctcacttctcagacagggcggttgccaggcagagggtctcctcacttctcagacggggcggccgggcagagacgctcctcacatcccggacggggcgacagggcagaggcgctccccacatctcagacgatgggtggccgggcagagacgctcctcacttcctagatgggatggcagcctggaagaggcgctcctcacttcctagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggctgctgggaggtggatgttgtagcgagccgagatcatgccactgcactccagcctgggcaccattgagcactgagtgaaggagactccgtctgcaatcccggcacctcgggaggccgaggctggcggatcactcgcggttaggagctggagaccagcccggccaacacagcgaaaccccgtctccacccaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggctcggcatcagagggagacggtggaaagagggcagagggagagggagggggagggggagggggaaagggagagggccaaagtcatattctcttaaacagatattggagagggagagggagagggagagggccagagtcatattctcttaaacagatattgtcacctaataattgtgggcaagaggtaatgtgggaagccaatgtcagtcccttctgtcttggtgtgaatttgtttatcagcatcttttcaagaaagaggttgtggagaagtaagcatgacatcaggttacggagaaggcccagattcctggagagctgtgcttgagaggaaagcctggaggaggaaacggaaagcagataagcctgttcgattctctgtttcaccaggggccaacccaagacacagctttggaatgtcctgtccttagaactgttgcccagggccactcatgcctaaaattacaacacagtaataaaaactaccggttgttgggcacatattaaacatcacgaatatatcctcttgtctaatgacaaccaccaccctagggggtaggtgttataatgaccattttatagatcaggccactggggtaattgctgagcatcatcatttagtaaatgccagaaacaagatttgaatccagacttgtctgaacctaaagcctgtgttacatcctctaaatatcactccttagccctaatcattccccttttgtgtttgtgtccagcttctagcttgatgattccttttggaagtgctaggaagttttaaggagagtcactctgaaattgtagcaagagaaagcatacacagaatgggatactgattgaatgcacacaaaggtatccttgggcctttctgacactagtcaccagtggaatttttcctctcatagggtctaccatctctaaaagagaacagagttcagccatatgagtatcttttgggagcctccagagtaaggatagacttctagaactttagctacaactcccctcccaggttgctttctttgtttcaagggaaaaattgagaagttggaaaataataggaaaaaatattctaggcacttggaagcaaagtggaaaaagatagtcactggaggaatttgagaatcttgctttcaattttttctctagagataatttttttttgtatccatatggacttacccatttgctgtaaagcagagaaactcttaaaaagttttttaaaaagggaatttttgacaacatcttggaaagctgaagttataaatattataaacagtatggtggataacactgccaaattaaaggcaggagctgggcaaggtggaaaagcaggaggagaagcagtctggcatagggactcataagctgtgtccagcccgtgattcccacattcttaagctttcctgtttcaaagccaccatgagagcttgagccggcttgctgtaaacgttgatgcttgaatagccaaagctgggacagagtcacggagcccctcttatgacaggacgaagttggctttctttatacatcagcctgagtagcttacattacagaagggcaggccctgatgctcccgaatatttccatacctaggagaattggaagcaccaccatgtgtttccctcatttctgaggtccgcttctaaaattaaaactgtagtgtcaggaccccgcaagctctgccctatggagctgtgcatctccaggaccacactgtgctgcataagacatgtgatcttgtgaggttgctaggcccccaacactgatacaggtggacaaaaaaaagaaggtgggtaaatcgtgcataaggctgtgacctctaggagtatagaggaaagagacagataacactacaagacagacatttaggagggcatttccctaaagttcattttgctttttggtttggtttcatagtttttttcttcttttttagttttggaaagagacagaggaaggggtattagaaggacgtggagacctcttagatatggaacagacatttctggtacatgtgaccacaaatgttgatatctgcctcccatcccaccccttctttgtgaccagcctagaagccaccttgaggccactgtttgacccatccccaacatgaaacagcccatcctccagctttcagataggaaggacttggctgggctgctacttccatggtaatggggcaggtcgaggtactgacaagacttcccaaggaatgaagagacccttgctttcgctccttctccatgtcaactcctttatgtggtcaacatgccccaatgtggccccatctactcttgtcaagggacctctcattgcccttctcccttgcctgccatgctccagccattatgactttttttgggttccagaatgtggtatattgcatcctgtatggagtcttttagctttagattccctaggcttggtaggttcttattctccccactcttggtgcctggctaactccttaggtctcagcacaaatttctctttattccttcagtaaacaaatattcttgagtagatctattatgtgctgcaccctatcctaggtgcttggggctacatcagtgagcaaagcagacaaaaaaccctatccatggacctatgtgctgcctcttccttaagaaattcttgtctgttaccctccccttggccgtgctgcacccataggctagattaggtcttccttcctgtgtacacgttcccaacactcttctctttcacagtaaccataacagcttgtcatcatatacttatttgtgctttctttattaaatgctggtttccctgcgttcgactgtaggttctacaaggttggggattatgtctgttttattcaccactatatactcaacaccagcacattgcttgacacccagtaggtgctgagtaaataggggtgaaggaatagataaatgaatgggtgacaattacttttgatggcaaatagcaatatcaggtatgagggtcccacacacttctgggaggaagttgagttgacatatgagttttatgaagaagctacactgtgcttccaaagtcaccagaacttgcaggttctcacttagccttgcctggggtctaaagctcctactgcctaagctttaggcatttcatgatttacaaaaatggttgtgaccatgcctgactttaatgcagcagctgtttgcctctccttccagactggagatttcccaaggggcttggcaaaaaactattaaaccataagaactacagttccatttatttggtatgcccagaatgtcatcttcccctaggctgtggtagcacccatagagatggtcttcctttgcattaattattttcatgcgctttgcactcagctacactggtattcggagaaaaatgctgccatgacaactgccacaacagatggtatttgatcagtctctaagctaccagggagatatatagcagtgcttccgaggtttgcatattttacgttatcaggagacccaagtccagccttaatcatgattgaaatgcaaagttttccatttgcttcctatctcctgattctctttccagttgtttggcatttgttttgatttttctaactccctggctctccttggtggggaaatacttcaggatatgggagacaaaggctgcaacacagcccatggaagttgccctgcaagtctaaaggtcagggactgttgagaaactaaactttgggatggcagtctcagctgagattggcagaaaggcttaattgcagcctctctcatggatgttcaggcactgcacaaggtggaggccacatttggctccaaacaaagggaattctggggaggtgcatcctggtctgccccttttctttacctccatccttcactcaacacctctctgctcccggagtctccaagccacgtggtagtccctctcctgggtttccccctctaccccagctaatgctgcaaattccaggaactcagtcccagagctcttggacccatttctatggcaacaactacaatagcttctcacccagtccccagcccccttcaaaaacactggaatgtcagacttcatacagatttttttcagctaattttggaaagtagtttatattggccactacatgctaatgaacaagtttggtcttatttacatactttgctgtttaagagtcttttctttcactctgcctcccaactttaatcagatcctcatctcatgctgtgtgtctggatcacacataagtcttgttaaagatgggcacgaggacatcattgtgctgtaatgactactggggtgctgctgctggggctgttcccctcttgagatgtggtaggagtttgcagtttcaacagtacatgaagatggattgtgtttacctgtacagtatttagaagaaaaccttaaggtgaattttaatcacaagagggcctggatcaaagaaacaatctccctttctgatctccttccaaatgaagccaggaggttggaagccacatctgaccccattctgcttcccagcctcactctcttcctggggtgcagatgaaagagcgtgggtctcggccgccttgtcaggagtgatttttaaccttaatggaatattattaaagagtggatttcagacttgaggaatgttttttgaactccttctgtgaacagagaaatcatagtagaagggaaaaattcaaggcacttgatggacttacgaatgatcttttaaataatgacaaagttctagttttaacatcttctggagtgcagaccagccatctggttttggctccctgtatttcatctctttagaagaaaacaatggtgccctcaggccttccctgttcacctaataaaggaagatcctaatgcctctcttgtctatgtgctctgattcttctagagaaagacaggaatcaaggtgtgtgttgaatcgcactgtggaccctagagaaggattatctaaattcaggctcctatgtatgacagggaggaggacctcctggtttctcacccagctctgccattgacattgacctgtgtaatcttggtcaaaaatctgacttccttacctcactttctgtatcacgtaatacttgctaaaaccaacaccatccaaagaattgagtgccatgctggcacagagcagacatctacacaatgatgttgactgaatgaatgcttgaaataatcctataactcagggcttctcaatctcagcactgttgatgttttggactggacagttctttgttgtgagaagctgtactgtgcattgtaggatgtttagctacatcttggcctctatccataagatgcgagtagtaccctgctcccattgtgacagccccaaacgctgccagacattgacaaattggtccctcacctccaccctccatccctagccagtggagaactactgatcaaaattataaaattctgggaaaaaaatgacaggactttaaaaagttaacaaagaagaagtattcgggtaacttatttataattattcattcttttaatagaatcggacattaaaagaaagtccagcagatggctgaattgaaatgtatcaaggctagccttgcaaacagacactatcatgtactttaaatgatgctgtatgtgttgaatgttccataaatataagtaatgtactttatgcttcttggaatgtgagttctatagaaatagtgttgtagtagagcagtgcttttcttgaatatgttggtggttgtctttatttttttcttcagtgccatattgctggactattgctgaaaaatcttaacctacctcgtcagcccacctccgtgacacttcccagaataaatatcgagtgtactatttttgattttgcaataagagattccgggatggtgagctttttctttttctcactttccatggggacataattgccaaagcctcactcaccagccatgtgcaagatattatataaaagaagtaggagagaatgataggaaaaggcaagcagtagaagagagattttataattttattattatttaaatactagtgtctcttttggggggcaacaagtccttttgagtggatttggtatattaccactgtgtacaaaagtagaaataaggactgatagttaacatttgttctcaaaagcagggtttcatggtatggtgaggtggcatttagagacacaactgttattgcacttacaaatgggagcagattgctccaagacatcacacacagggtactcccagccagtattgtgtttactttcccctccctcattccctctaagccaatagcacctggttgtctgcatttatgtaaatgcaggctcctgtgtataacagggaagaggacctcctggtttctcacccagctctgccattgacattgacctgtgtaatcttggtcagaaatctgacctccttacttcactttctctatcacataatatttgctaaaaccaacaccatcaaaagtggtcatccacggggctggacagaggacaggaaagatgaaaagaaaactcacctttcctccatgtgtataagaaaggactttctgcaatgatgaaaggcataacgcatagcatcaacatttagtttgcagcaaattgcattctgcacctttttctagagatgagaaaatgtcttccagatgaggaccttgaagtgtgagatggaggttggaaaggagatgggaacctatgctaaaaatgcaaggatggagtaacttcaagctcagggttgagtagagtgtatattatgggtgcagttttattcaggtatcccatagcttaatttaaagcacttggaagatgtgaagactgggagtagataagtcataaaatgccaaatgtcaataggtgggtggatgtgaactttgggaagactgccttggagctagacgctactcaaattagagctcctaagtgtagacactttacattttctgtggctgtgaaggagcattgggaaattgcttggagttgaagaaacgagaagggtcacatgtatactgtggaaggcaatcatttattagttcaaaataaattccatgggttaaatactgatttgagttcataggaatgttgacggaacctgggaagtaatgaggggtggggtgattgtggaggggaatgagtggggtccccattgtgaaatgcaaattgtgtgaaattcaaagacctctgtgccaagtctaaagcaatttcttttacttatggtacccgttgacattaatcaagccagaacattttcctttaaaccaaaaaacaattagccctgacaactgaagtaaaattagcttcttgggaatgacctaattgttcttttgggaaggctggacactggcttgcccttggctgtggtgtcagccctggcaaacctggcagatctcacagactctcgtgggtcctttcttgccacagaaagcacaaaggacagaggggttcaggaggtcacagccctccccagtcatttgcaatgcctgccatccggagaattttgtgagtaaatgctacccagattcctgcgaaaactcccattcactgttggtacatttgactgcctgcctctttggtggctggaaatttctcccagctgctggtagatgggtgtgtccactaaccctttccccacctccatttttctggcaactgctcaagttttcaggattgcactggtggtgacagtgatcaagatgagagctcccattccaccctggttatttttggcggctgtgagcaatgcaagacctcaacttttggcactatgtggttgggatattaggtaacctttttcctgtgcaagtacagacaaaagagagtgtcctatcttggcgttcgttcatcggccgtttttacagcattctgttttcccattgttcctcataagagatggctctggagaggctgaacatttattaagtatatattgttgtttttccctcctagattgaaaacatagatgcctgcttgaatttcctggcagctaagggaataaacatccaggggctgtctgcagaaggtgagtcagagcgcttgtcacgaagctgcctcttcatcattagaaatgcccacctgttacttatgaatgatattaacaccattatgacaagggatgcttgtgggctcctctggttttgttttcctttatgttgctcagtggttgcctagacttgaggatgccaaggactcactccaagaatgtggattcaaccataccagccacctctgcaagaccctgagagggtagtgaaggggaagctgtcctatttgagaaagacttgcttaaacaatgctgatttgattcacctgtctagtaattcagttaattatcaagtcaggcctcatctatgggagagagcatgcttcaccacagagcatatttcagctgtacagttcccggggaaaaatgcttaatccttatctcttttattcgaggaagcagcactttttcttgctcttaaaaaagcatgtgatttattaatgcaatgctgtatttttacattgtgattagtttttaattaaatttggtggctaattagcacatgagtgttcaccagtgttttgctattaaattagttattggtctggagatggctggttcgaattctcagccacctcagacaacaagtcagcctgaaactttcacgctctctcctgtttgtaaatacaagcagctgccagctcagagctgccataggcccaggcatcctcccaagctcattaggctgcacctgcctccagttttcccagaacaggtaaagcagtttgggcttcagatgatagcacctttccctagtgagactgctttttgaaaggaggcctgttagcatggactctggtggtcagagtggggcagagaagaacaatgaggaaggaaacagccaaattgagcaggtaagtttgcaagcatgatggattccatctgggacctgttccttgcctttgctctgctacacggtgaaagcttggttttcctggctgcgtttctgagtggtagtctctcctggtattgggggtgggtggtataaatgaccactattaatgcctcgtggatgtattgcgtctctgagtgggactgtaggaattcctcagttaataactctgatgtgctggacctgttcccagtcaggcacggccacactgcttccagagttcgcagaagcagttgtcgtgtggtcagtcctaatcccagaagattccccagccctggggtacggaccctcatccatggggataagatcagggctggctgacatgtggaatatgctttgctggggggcgggggtttgctgggagtaggaagatgcaaattcccattcagaggagcacatgatttcctcctggtagagagttcttgtgctggctggtaggtggcagggcatactcgtcctagtttctgggagtgcttgaactcctgggacaggcctgtgtcccccagcagagcaccagcagggacttttacagaggtgtgtttggcagcaagtggcagcagggcctcttgggtatgcagactctgcaggcctgcttcatcctgcctggctggtagtgacccctggctactcagccatctacccattggcctgacttctgcctcatttgttctccccatctgtcccatcctctctgtaccccaaggcatagagaatctatgcaataagtatttgttgaaagaacaagtaccaattgtactttgcaggattttatctgtattggcttcagttctcacaactaaagttggagtttataacagcctcagtttatagatgaagaaactttggtttaaagaggttatgagcggcatccctgaagcatgtagctagagagtggcagagccaggatttacacccagttctgtgtgatttcagagctcatgattatggcgtcttctgggatagaggtggataaaatctaggtatgccatataaaggtaaaagaaatgaggtttaaactctttgtcacctggagcattgcttcagaagatgttatagcccatggaggcacatcatgcagaaagacactcagctgtctgcccctttttgacattgagatgacccttggaggctctgagcatggaagagcataccatagccagtgtgctgtggtatcaagccattgtggtacaaccatgaaggagttttgtggtatttcaataactgccttaactgtgctatgttgaacccccatccttcctgctgggtcaagactcacttaatgatattttggccaggatatataactctgtagtcatcttcaagttgttacaattacttgatgcccatatttatgactcagtgacggtcatttttaaacttcaatctcagactctactcaaagctctttaccctcattccttccagtgtaaatggctttaggagtttgaagagagatgggggcatgccggcgtgactttctctcctttccccttcccatgttcttgtgccagagcccccaggattgaggcagcacagaggaagcagagttctgctgctggggaaggtgctgtcctcagtatacatcactgccactgtctcagctggtagtctcagcaggccctgctgaccaggacttactcccatgtagctcccggggcactagtggtcttctgtgagacttggccagatctttcacctcagtcttatgatccctccggtacctaccataggactagcaggaacgtgtgggctccattttccacttgcagtgggtggaactgcaaggcctcctgtcacctggcagcggtcccccaccagacagtctctctccggttcttttcctcattcaggtggccaagaggcagatcagccgggtctctgctaagcggatgtccaatttgggactggaatgccaggccctccttcttgccagcacccccactttgagcgattcttagagctaccactcccttgacttcaaggggcccaaggactctgctgccttgcctccttggtgaggggaggaaaatatcctttctccatgatcatcaaacattgtctccccaaaatgacattctgtcatctagatcttcttatattttttggaggttggggagtgatgaagatatgagtgttaaaaatgtgaactgctgcattcctttgggaaagtggccccaacgtctgccacattctcaaacttacaaaaagcaagggtacttacagcctttaatcctcaaatttggccttattcataatttcagggtacaggcaatatctcacttgacatcatgttacattacagggatagatttattgagaacttaccacatgtcagtcactgagctaagtgctgtgcatatttatatcttatttagtacccccagcaaccttatggggtcagtattagtattatccccctcatgcagatgagcaaaccaaggcccaaagagattaagctacacattataaaaaggaggcccacaagatcagcagtggctaaactacccacatctgctgattcaaaggcctggtgtgtgctactgcacattactgcctatgtttctatccacctgcataactactagcaaagcagtgtggtgtattaaaaagtaatgcagatttaatgctttttgttctccttttgaagatgactgagtgccctgaggctccttctctgatgaagaaaacatcagcagttggaaggccccatagatacatctccaccctttcccagtctaaagctgggtttgcactcaggagggtgtatgcacctgtcctcaaagcatttcagcagctcaggcctgccccgacccgcctgctggagagccacagggagcctttgttctagggcacagacggcggatgcttgggggcagaggctgcaggcctgagtgagccccatggaggtgctgctggtttggggaacttccctggactaggcctccctgccctgtcagttttcctgaagattgaacccatctatttgctcttggagatgtgccagagtcctgtgagcttgggcctccctttgccctggggtggtgttcaagatcccccaccaacccttccccagaacacaccacctgtcacagccatctgtaaaactgcccctgtgaggaaggatggcctttatttctggccattttgagaacacctggggtttgtgctatctggccctgagcccatcctcctgcaatggagaaatggaggttggggagtaaggcatattctatctagttcagcaaatgtttcctgggcacatcctgtatgccaggcccagtgctaggcactagggtacaccagtgatcaagccagtcatattaaactaaccttgattccagttaataagacagagctgtgttagtggtaagcacaggatccggtggtgaccaaagacaggcaaatcaacttttgctggggctctcagtggggctacacagaagtgggacatttccccccagatttcatgggatgaatagacatttgccagacagaaaaggaaggtgaaaggaaatctagacagaagatcaggcataggtaatattaatatgatggggggaaaccttgcagacattggataaacaaaagtaggaacatccttccaggtggaaggagtgtatgctttgaagtgaaaccacttgctgatttgattagcttagtcctgggtttgctgccctgatggccagagagatctaggtactgagttttctcctcctttcatcccaagctagaaagcaggaggtctttctggacccgtacggtgaaagcagcaggtggaacatttccatttcctcctacctatattacctgagtatggcattgactgagaccttcagtttctgtttcttagcagaagggtccccataggctctgctcccatcctctcatcccacttctcctgtgggtagagtgattggcagacttggagagcagcaagaacacagagggctgttgagtggaggggcaagttaagtggtgaatgctgattatgcagccggcccaactgcagggacaatgctgcagaatccacagtccttaatcagctgggtaaacctcacacaaccatggctcaaaggaattgaataggagttctgcagctctgtggtttgcacagccctccctttggctttgaatcccttataccctacaaagcaggtttctttgtattagattatttcagcacttgtgccatgtaaaccaagcctgaagtttctctttaaaaatgttgaaagaaaataactcctatttatcttactcttcatgcctgacattacccacagcatctatgcagattaggaccagccagtgggaagaaagcgattagtcagaacccaaagaaagtggagtcaaggcaatactaattcaaatagaaattggaatatgagaatatggcccatgcaatttgcttttctgttgccacaagagtggccacaggaagagaaagaacagggctccaggttgggtttagccacaactggctagtgtctcctcaggcaagtcagttctctctacatctacatgtttttccttctctagaactccagaaagtgaggttaatcagatacaaaatagtaactccttttccaaagccttggggaatgtcatgagggaaacattcttgtggggctttggggttttttttaggcttcctgtggagctggcttaccaagcctcatggaacacagacaaataccatttggaaatatggaaagaatataattctagctattttagatactgtctgctatagaccacccatggtagaaactgtgtggctgtcagcacattcagcactcttgagtttttgtaatctgaaaagaaaattaaacagttataatgtccatcaattggtgaatggataaacaaaatatggtgtatctatatgatgggaatgtaaaaactgacaaatgctctaacatcgatgaaccttaaaacagtatgttaagtaaaagaagccagttgcagactgggcacaatggctcacgcctttaatcccagcactttgggaggccgaggtgggtggatcacctgaggtcgagagttcaagaccagcctggccaatgtggtgaaatcccatctctactgaaaacaacaaaattagccgggcgtggtggcatgcacctataatcccagctactcaggaggctgactcaggagaatcacttgaatccaggaggcagaggttgcagtgagctgggattgtgccactgcactccagcctggatgacaaagtgagactctgtctcaaaacgaacaaaactagatgcaaaaatctatatacagatgctcctcaacttactgtagggttatgtcctgataaacccaccataagttgaaaataaatgcatttaatacatctaacctactgaacatcatagctcagcctaacctaccttaaatgtgctcagaacacttacattagcctatagttgggcaaaatcatccaacacacagcctgtgttataataaggtgttgaatattatatgtaatttattgaataccataccaaaagtgaaaaacagaatggctgtatgggtacttgaagtacagtttctactgaatgcctattgcttgcacaccatagtgaaggtgaaaaattgtaagtaaaaccatcacaagttggggaccatctgtattgcatgattctatttatgcgaaatatccagaaaaggcaaatctgtagaaacagaaagcagattagtggttgcctgggagtgggtttggggattgattgtaaatgagcacaaggaatctttttaggatgatagaaatattttaaatctagaatttgctaaatttactaaatatcattagattgtatacttaattttatgaaattataactcagtaaaactgtttttaaaaccagaaagattaccattgagttttctctaatgttagatcattcgtggttttcctttctggacaccagcgactgtggcacacaggggatgagcagagagaatggaccacttcttaggcttcctttgggtgaagagctctgtggtgggttctgaggaggctgcaggtagaatggccacattttctcagccaaaaaagggaagtacagagtcgggaagtatcctaggtgcactcagtttcttatgtatttatttatttattatttatttagagatggagtcttgctctgttgaccaggctggagtgcagtgtcgtgatctcggctcactgcaacctccatctcccgggttcaagcgattctcctgcctcagcctcccaagtaggtgggactacaggcacgtgccaccacatctggctaatttttttgtatttttagtagagacggtgtttcaccatgtgagccaggctggtttcaatctcttgaccttgtgatctgcctgcctcggcctcccaaagtgctgggattacaggagtttaccaccatgcccggcctcattttctcatttaatcttcaattaactttcataacaatcctacaggaaaggtacagtaggacatatgcccattttaaagaagaaaactgaggctcagagagattgaatcctgtaaaatctcaaagtgtataaacgatggactgtagagatttaaccacaagattttctggctccaaaaaatgagagctgtttgttataaaaatgctgcctcctaagaggaaatatatttattggaggagcactgtagtctctgacaaatgaaaaaaatggtttagggaacaatggccattctgatcaataaatgactaaatgacaatggtaggtagagaatacaacaggactgatgctgtttgcactgggattgggctggtaggttatggagggagctgatgtgaacgtgcctactttttacagtggatgacccctgatcctccaggtatgctgaattgttagttcctctcctgttttttcttgcatggttaaaaaaaaaaatgcatcacagaatatttgacatcccagaaaaataaagaatactcaaatgcctaccagctaggattttacttatttatttatttattttataaaataaacattaaatatatttatatatatttatatatttatttatcaataaaaaatatttatttatttaaataaagaatactcaaatgcctaccagctagcatttattttatttattaaaataaaacatgatggctatacaagtaagtcaagttacacagtgttaggaaactggaccctgagtcggaaaacctagattcaaatcccagctccagtgtttatgaccttggacaagtcataaaacctttctgagcttctgtttccccttatgtgaaagagggataatcctactcacttcccatattgtaaggattaaatgagatcatgcatataaagagcttagcctgatacacactggttaataatagctcttattgttataaactatatgacttgataactgtaaaaggcactaaaagtaaatcttacatagatttcatctatccccataattagcagtactttctccctccagtgaattcagttttgaggggaaattgttttcttaactttaatagacactaactagcatgtcagaccttgcttggcttatcttcattcttttttttttttttttttttgagacagagtcttgctctgttgcccaggctggagtgcagtggcgtgatcttggctcactgcaagctccgcctcccgggttcatgccattctcctgcctcagcctcctgagtagctgggaccacacgcgcccgccaccacgcccggctaattttttgtgtttttagtagagatggggtttcaccgtgttagccaggatggtctcaatctcctgacctcgtgatccacccacctcggcctcccaaagtgctgggattacaggcgtgagccaccgtgcctggccggcttatcttgattctgtccctagctcttgtcactgcccagttgggtgactatagatatgtcacttcaccttgtgggcctttgttttcccataagtaaagtgagtagccagctgaattatttcatccaagcctcacactctgtgattctcatgtaccactgagaacatttggaagcagaagtggaacatgctacaggtgtgtggctctcatttggtttccttagtgtggggaaggaagcatggctgaaggattaaagctgaattaccaaaagagactgaggggctggcccaccccttggacatttctctgcttcacacatcacacagagtggtttataagcagtgactttgcatcctgacttgtccacatcagtcctggctatcaactgtggtcctggtataattaagagctccccactccctggctttcattctcagaagcgtcatagttagcacaataggttaaaaggtcaccatagtaaaaactgtcatttttaaggtatgaagctggagctgtatgagaatctcattcaggattctggggctatagtcatataataaccaagatgaatgaaggacttcactgtttaaagtgtgcttttgcctaagtgctcccattagttctgcaaaacaaccttgtgcagtggggcaaagcggtgtccgtattgcccttttactgaggcccggagagattaagtgacttgcctggggttgcacaactaagaagtggtaagaatacagattggaactcacggcttaggttttccaaatgctatgctcctgtctactttgtcctgtgatcagaatctgctagctcccaaagtagggtgtgaaggctggattctagaagttcgtattgtcagtttcttcagagcctggagaaagggatgctccaagggaaataattcagcctgacctaatcagcaaatcacactggggggaaggcactggcagggcgcacttcctcctctgcgtggaaaggagcttgcttctgaaaggactccattcatactttctgccccccaactaagccttggaggaaactcttgttccttcactagcagcctctttcccagcccggggctaacctgtaagtgtgcattacctacccctctaacaaggcctttgaagctttcttgcttcacgtctgccttttcccccttgccagttaagaaaaacccatcctaggatgacaggaaagcagagagtgttgagtaagtttgcccccaaggttccctttcctctgtccctcacgctcagtagccccagaacttcactctcaggatctgctcagactctggccatctgcatctagcgttaactgcatagaaaggagggatctcccaaggagaagcccctcgtgagccatagcctttgcctgtgaataaatattttattctcctctgcaactctttatgcatactttgaggcaaatgcattttaacattgaaaaatactgtctggaataaaaacaaaaatttgttcccactctgttctaatttcttttaatgtagggaatattttgtatgagtccattatggaagcaagtccttctagcctaccctatacccaccccaaattagagttatctgttcagcagatgggggacacagagccacgtatttgagagtaggacgactggggaaagcagagcgcagatcatggagtgggacagcagccacttggcacactcactgtggcttgaagcttagaacatggacttggcagaagccaagtgcactgtgaagacccatgagcttcccccagtgccagagttcctccatcccctgcctgtagaacaagcacggtcttgctcgagacgcttgctttttcattggtgtccttactgagaatttcctcttggcacctaccagacatccagttgcacttgcctcctgtatccactccaatcctaatggcgagaataagctaatttctttgtggtataggcctgattttaattgcctgtgataccaatgaagtgttcaggaagcctgtcatatcctaaagaaatcaaactcacgtgccgactgaaacagcccattgaacaggaagaagagctccccatctgacaagagtctctttattgtcttgcagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccaggtgggggctccttgccaactgatggttctgtttttcaggcaccttcctccaccccaaccaatctctaggctatcctgtatggctttttcatttgtgcttcttcaatgctgagagctactggtggttagtgggaaattagcatggccttgaaatgcatgcagtgaggagcccttcttgtgtctggcagagatgtatacttttataggtcagaattgccagcagccaaagctaattacctgctcctgctattactccggcctattacacacatgctcgtagacaataaacagcccctaaaatagacttcaaacaccttttgtgtgtctccctacaagctgaatgttcactgttataaatgagagtagttttacttagtggaggtaaaagttctattcctgtggatgcctctgctttgccagaacagaaatatagagggcaccaaagaaaggtggcaagggaaggaggcagccatccctgagcggggcagtatcgcctaacgggagcagttaccattaaatgtgactgtgttgtgttgaactgagatggggagagtcccacaatgcaggagtaatctgcagggttggggtctggattttgttcccagggggactgacgtttgccagtcatactcaccaggtacaagccaattgccactgtagttaccctctactgtgctacagtggaaataacatcaccctgtaaaacttttgtcttaatggtagaaaaaaaaggaagactttaggaactagagtttttgacttgaggtcaagttctacagaaaagttcatactgttttcttttaagccacaagacttcagctataaaccctaaatgtcactgatcagattgattgcttgatttcatccaatatgtgctgaagagtaatggccttttcttttcattcccccaaagcaccagcattaataatcataaggcttctcacacaccttgatataccttttattacccatttagttggacagagcacaaagccgctcaaacacagctgctgccttttagacagttacagccttcttttttccccatgagaagtgctatttcccagttgtgatgatgttaaaaccagcactgatgggtgtaatgcaaatcaggtcccataattaattatctatttatatccagtttgcattgtgggaatttgtggggtgggagagatgcctggactagcaatgaggaacagacagccttatcagccatttgccaaaccctttccctggagaactgcctgagtgggagtcactcccagtcagagcttccctgatggacatgggttatttaaatgatcagggtgtcatttcccagactgcattctgctgagtgctcattccctgggatgttaacttgggtcatattgcagttctgtggggggaaaatattgggagataatttgggttaaattgctatatggctctcattgtaggtctactgagatccttgaacctgccaatatgcatttgtttatttaattggtattaagcctcccacatgccagacactgttctaggcacttgggagtcaagaatgaatgagattgccgaggtgcctgctctcctatgctcctagaggaggcaggcaaacaagcacatgaacaggaaagggagctatcagatagtggtgagtattataataagatgatgggattcagaggggctgggttgctaatttaggtttggttgatagaaaggtctctctcaggacatgaagggtaagcttggtgtgttggaagagcataaacaaggttattatagcttagtaggggaggagagggatcagtgataaggtagtttggaaggagagagggctgctaccatttatgtggatgacagtgtgacctgtggtccctggagttgcacattgctgtggcactcaggccccgtcatagagtaccagttaaactggatagggtttggactccattctaagggtgacaggaagccatgggaaagtcttaaagtagtagaaagactggatctgattggcaggtcaaaaaatccacctttgcttctctttggagaatgagattgtggaggagcaagaatggaaggaaggacctcagttgagaggactttgcaatcctacagatgagttgggccaaggtaatagaagcaaaaatggagatggactaattctgaatccttagggggttgagccaagaggcctgcaaacagattaactctcgggaataatggaaagagaggaatcacagataaagcctagattcctggtttgaacagttaagtaagtggtggtattattctttgagatgaggaagcccaggagagcaggtatgcattatgaatgttcagacaggtggtgacacagaaaggagcattctacaaacttggccacgtcactcttcttattttatagagcatctcactgcatagggttccaaggaacatgcattgagaaatagtggcttgtgtcactgagctttgctaacctgaggcatccatttccatggtaggcgtttgttttcttaaaataaccagatattccagtcagagcacccatctcccagtaagccaaaacatcctactactaacgagtgctttacctaaagaagagccaaacttacttgagtcaggtttttacattcatttattccagctacaaagtgtcctgccatcatggccccctgaccctacagtggtgacatagaccgggctttggagttgctgtatgtcctcatcccttcatcttgcccaggttgggttacttctgcagaagactggttttattcactatatcctgatactttctaattgtatttccaaaggataatcttgttctcaaggtctagggatatgctatcccatgctaacactctggctataaatttaagaatgataaaattacatcagtggctcggtctccaaattctatctttgataaccaaaattccaagggcagtggtttggacgcttgattattaatgtcaaatgttgatgcaaaccccccacatgccaggtttgttttgtttttctgttagaactctgcctaaaaactattttgaagctatctaggttcagcacccctggggggtagcaaatactaaagcttggacaacattccatgaagtttgctggtaaaggagctatggaagttggcaaagaaaatctgagatttttttttgctccactggcatgaaggaatcagagcaaatcttccatgacagcttcatagaggctcactttgcttcttccccttagctcatctcataactgacatggtggccaagaacttaatccacatttcaccctgtgaaattccccactggtctagagtccaggagaggagcatagtctccaggacttgctttttttcctccatctgtgtctacacagataatcagtattcagttgttaaagaataatccagaaaatgactttatatttttctctattctcctctgtctcttcactgcctaagactagtaaaaccaataaattatttcttacctcagatcctttcatgaacatggtacaggatgtatggatgcaagaaagataaatatttctatctttcagaaagcagtaaataagtttaactttttcttttattaagcctaactaaaattctttatatgtaccaatttatagtacaagaaaaacagaatttagtgagtttaacaagcattaaatggtcatttctatagcattaaaagcaaaaatccccaaggccagcaacatctgggtataggtttgcaaacatcttgttttgggtcacctttatgggatactgaggacattcatctgaaaagcaccccagtagaacaagcatgtgaaatagaaacatctcaatactttagaaaggcataaagtttgtttacttgtgagggaccccatattttgagaataaggccttaaggcaagaaagacatttgatgtttaaagaaacacacacatgaatacatacacacaagcattcttagataatcttaaaagcagtttcttcacattggaaatctatcaaatcagtaaactgagacctagaaagaaagctgtgtgtcatagaaaacagtgggcagggggggaaagaaacagcaacatccccattgtcagaagactcttaggatttgtgtgtctaatgtatcttctctctcctcattcagctcttccacttttttctttcctatcatgcagtgcatcatccaaggactcatctcaaagcaaaatcatccgcttcactctgggtcagaaaaagatctctaggttagactttctctgtgtcctgcaaagcatggtttaatcccaacccactgttccattgttccctctgttctggctgagtttgcctttggtcctctcctcgtttcatgtttgcagttcgagaaaactaaatgtgctttggctaatggtcccatggtgcagagctttgaaagtggccatgggattgttgcaagtgtgtgtgggggaagtgacagagtgcaagtgagattgaggtgtacatgacgtttcgcattttcttgacttttggctttgactgctttgtcatcagactccattctgatttaggtaaaggtgagtttctacatagtttttatagtggttttatgatgagtttgcttcctgcttcgtcctggccctaatcccacctcacctgcatctcatttatgtgtcttgtgctttgtgttgttgttgttgttgttgttgttaaaattactaatgtgggtttggttttcccttgagttataaagacttgagcatgaatccatattgggcagaggagacaaaacagcaaggcagctatgtctcgtctttgtttctggatgctcttaggtgccatggagaccgcctcagttccctgaaaataaaaaacaggcttgctcacaagctagttctcttaattcagacttcaacctgtctgctgcctcctatgaggacccatcctatggtatgggaaaagccagttatatcacgttgcatcattgcttctactgttattttcaaggtatcaacagctaacatttattgaacgcaccagttcaaatgtgtcatcttatatcatcctcatgccaggcttcatgaggtaggtcatattattgtctccatttcacagatgaggaaactaaaatttaggaagttacatcattgtgcccaaggccacacacataaaaaatggacgaaccaggatttgaacacaggtggtctaactcagaaccttcactataaccacagtgctacactctcttccctctccttcaattctggtatctctgtggttgttgaggctgctttttaaaatcttacgtttcaaccactactcttggctttttctctcacactgcccttgtggcatcctaacagaaattgctgctggggtagaatctccttattatgactggtatttatttttcattgaattcttattgaattcttattcttatatttcattgaattccatattcttattgagtattgagtcaccctattcttggttcacagtatgaatttactcttgtttaaattaatgaagtattaaacaaatttgcaagtgcatcattttagtatacatatctatagggttaggaggatattttatttgctttttggctttgtataattcttacctaaatgattgcagagatatccaagtgaagtgtacttctacaatttcaatacatattcttattgagtatggaaagggaaatccatactcatgtctgtcttcatttatcacaaatacatacaaaataactgctcacttgctaccccagtgtgttagcctctaggtgcctttcctagccagagtttacttttctttttttagacagggtcttgctcactctgttacccaggctggagtgcagatgcactttgaaaatgttcatctcagactcttgtgtattgatttttgtccagttctgatactttaacctagactcatggcgctatcatggcgctatcatggctccctgaggccttgatttcctgggctcaagcaatcctcccacatagctaggactacaggcacatgcctccatacccagctaattttttttttttttttaaaggtggggtctctcaatgttacctaggctggtctccaactcctgggctcaagcaatcctcccgccttggcctcccagggcgctgggattacaggtgtgagccactgagctgccgaacctagagtttggttttctgaagtgcttacacttggggagacccaggtcaggctctgcctggctggcgaggggagaaaccgtatggcagtgtgcttctccatagagcaagtccacacgttacccagactcggtggaggaggacaatagggaacccaagtttgtcaccgcttctggtagccatgcagaaagtggctgctttccctaacaacaccaggcccaagtcagagtggaaacccactgctctggcaaactggtcccttctcagttaggttgaatgtcacacaaatgcacatacataggaaaggaaaggggagggatgagctgggaggaaacctgaaatttagtgcctgttcccacgatgtgctcagtcctgcaagataaagaaaacaggacctagctggggaaatatctaattggaagcacatgcccatcccgtgaatgatttgttatcagtcccagatgatggaagaaggcagggggaagagaggaagcactggaagatgagggcgtgtcaaccctgtcctgaggctgggctgggcacagtgcttctgggtttaccctaagccaagatctggctttcccttagtgtcatatcccctacttagagtttctttgagatacgcttttgtctctgctgaggccaatgaagggatgcttctttgtttcaaatgaagcctttgaaggctcttccttgccttctctacacccccctttccccacccccagccttgagcaggatcctgtgaagaattttagctgatcaagcaccactaagcacagcagtaaagtttggttgccaaaagaagcagtcctaccccttctggcagagtaggccacctcccctggagctctggaaataggtctcctgttggagaccaagcattggtggaacacctgccagaacccaacactttgatgggcaccaggggtattgagaagaatgggaagcctcacccttgaatctggatgtggggaggggcgtatggagggaattgatataagggtgaaagctctccatggacttctgcctttgaccactcttattgcctcccggcctccctggtgagcccagggaggcttattttacctgcaggaagcagagaagcatagtggatatgaggtgcagttaaacctaagcgaaggcccatccttaccacttactgatggtgttacctgggcaaatgatttgatctctatgagcctgggtttccttattggtcaaatggggtagtcttgccttgctcacagcattgtgaggcttaaaaaagtcatttaatgaataattataaatataaattaataaagtctttccttagtcctgacatataatcagttcagatatggcagtgttggtattttgggttcatctgggtcaggtaaggcaaccaggctgcctctagaaagtcccacagaattgatctgtatgcaactatcttgtggaaaagaggcagtggggttagtagtttggtcctctctgcccagctgctgggctgaaaagcagatgccatggaaatgagagatttagtatgtaatcatctcgcctggcaaaaagcatctctgattatgaccgccccccgccaaaccccagcatgtgcacacaagctgccatgcttcctgggagggggcatcctctgctcccagcctctgaagtggttttgggggaaagaactgttttttttttttgccatcagcacgtacatcgcgtggaacagaggagccgggatgcactcgtaggttatgtgctgggaatgacagttttactgctctgcttaattggctctgcacacgttggagaaattgaccatggctctaacagcagcaggattgttcccccaccgcttacaccacttcccttaagcttaatattttaaaaactcaacatgtatatgtttcaaaggacccgtctgtgttctctgttatttgtaattgtgtttggacatacagtgattatgagaggtcaagttcctcttgggaaggagctattgggactttctggtgctgtaagggatgcagggttgacctgccacgctcccctctcaccacgctgcctcagtgaggcaggcccagtaggcagcatccgttgtgatacctgcagctgttccacaggagccaagacctagctcttcagcaaacagggattctaatgctccagatggcagatgcttccagactggaggttgatagacattcccatgatacacaaggatgttaccaataatgaatctcaaaatgttagccagaggcctcggctctgtaccactggtaaactggaagatattctgcttttcacctctacctgtgctctcagcctccttaattaacaccacatccctggagggcaggaccaagtccaagctccatagtgtagcatacaaagtcttcccttccctgccctgctttcttctctagcctcgtttcctcccactctgtcccccgagtcccagcacacaccagctctttctttcccctgtactttctacaggctttgcttcagagtggcatgctctgccccctgctttcccatcccctactcacattcccattcagcgtgccagacttgctctggggtcttttacacactacctttcctgatcatctcaccaacctccgagatcttcatttccttctctgaataccttctgaacttcacgtattttaccaatacatctgtaatctagatgtcagctggggtcgacaagccccttgagatccgggtaagattgagcattctagctctgcctctttcagtttgtagaaagtccagtggcctcccaggtttgcttgggtgtctcaggttcttgtggtcacctttggctttgaaatcctgcacttgaaccccagtacttaaaagttcagtctgaattagttcagtttgtggatggactcatcatcccaagagatgttttggttccctcctgggtgagtccgggcttagctttttttctttcttcccacttaccacacagtcattatggcctttgtttgtgaaccaaattttgctgaaaatgtcagacggaggaggcttactttggagcaagcaacgatctgagcccatttacaacagaacctaagtgttaaactacagagtcaacatagattctctctgaatggtgggaaaaagtacatgatctccatccagttttctgatttgatcaagttcagggagctgtcctgactagagtgtagaggcgatagtggtcaagggtggacaggagctggcttgagctttttggtggcttttgacggctatatgcaaaccattcgccctttgccatgtccactatcctcacagtcctcaagaactccttctccatgtcccaaaaggcttggcacaatgctgcagccatttgaacgatgtgctgctcccatcaaaagagtagctagccactgactcagtgaaaagaatctgaccatgacaacccaaggaaaacccagaactatcttagttaatcccaaaccacggatgtttcattccagagagtggagcccacagataccccaagtataagatctcagtcagccacagatacttggattgagtagtttctcttctggaatgttcctagggagatgatgagccctgctcgccgaagcctatcttgcctctttgaaaatgttcatctcagacttttgtgtattgatttttgtccagttctctctgatactttaacctagactcatctattttcttgatttatccaagtatttcttgtgccatagcatgtttcttttatgccagtgtccaatcccttcatgaacccgtgttcactggagaagacgagaaaggaaactaacatacggtggctggacattaagccatttcagatttacagctatacccaatggtataactgttaactattgggtataactgtaaatcattattcatcattattccaaagttacaggtaaggaatttgaatctcagagaagttatgagactgctccaatgtcttgtgtatggaaaaacctgtattctatccattacaccatgctgcctcacagaggaccagactgcctacctgatttaaggttgtgtctttcccatcctatgctttgattgcttgcctctataaagtccttatcctgtcctaaaaatctgctgtggttcagcctagggtcagcacagcaggggctctccagcaactctgaaagaatgcatcttttccctcttcattgctttttgcttcccttctctttgcaaattccacactgtggtagaatactgtgacctgcgttcccctacaccacttaataccattgctctgacatcatcttggaacaagtccataatccttttctaggcctatctgtgggcataatgattcccaaagactctgtctggtttaaaaagtccagcccaagggaggcccagatcttcacctgcagaagctcttccattggatgtgagtaatcagataacactgacttgaaggacttgcagaacattgtttgcattggaagcagaaccaagaggtactaagatcccactgctggacctccttggccagatgtgctagccacatctggtccccaaacacaggcactggcactgctagtattttgtactccgttctgtgcctgtctttgtggagtgaatgtcctctccaaaggagatgaggtaaattaaccaaggtacaaatcctcgcagcacagtgggaagtaattctcactgcaacttgttgggggaagagctaacccccttccttctctcccagctcccagtcagggaattgggccagcttctttttaactatataatttttacagtcccctcacaccagctcatgttctctgtttactctacaaccatctttcttgcccagccaacaagaaaagtttaaagtgattgcctgcttatatctaaaatgcttccagactgtagacttctttggtgcttacagatttgcatggaaagagaaggctgaaagttttatgacttgaaaattcagacttgtcactagatctaatgctagtcagctgaggttccagtggcttttaaacacagctaagtggatttcaagctgaaagatataactaaacatttcatcatttattcatctttcaactttaattattggaaacagcctgcttagtaattccctggaccaaaatcctgatttgaggagtcttaccattaactctttggtgaatgggccataatatctttagacacattatggatggtgactttatttcccaagccacccaaaatgaggtgttttatttaaagggagagtgtgtgtttgtctttaggccaacaaattcctgccagttttacaggaagaatatatgatgttatccatctactgtgcagataagttgtacttcagcctcaaaataatgcctttggagacaggtcatcaggtgttgaagggaaatgtatgtgtgggcaagtgtttccaaccaacctgaagttttcattgcaaatatgttggattctgagtggtagtaattcaccttctcaccactataaattgtccttttcttgatacttacaaccccagattatggcaaacagtttttatacctatcagaagagatgcacacacaaggttatcagtttagaatcctctgagggctttatgttccatgcttgataaaattagaaatgactggcttgaccctattcaaaagtaaaaatacttatcccagagggaaaaaaaaaatgaactttgtttttgttttgttttgttttgagtcagggtcccactctgtcacccaggctggagtgcaatggcgtgatcttagctcactgcaacctctgcctcccaggttcaactgattctcctgtctcagcttcccaattagctgggattataggtgcccaccaccatgcctggctaatttttgcatttttagcagagatggggttttgccatgttgaactttgtatttttaatccacaaacatatttcttcatcaaaatttttctctctgctcaaagggaaacttcacattttgctgttggactttgctggggtcattacttgcctacatgtttgtaatggttccaccaaattctgtgactggcaaacctccacacaatgtcttggatagtttcttttgcctcctgcatggttgcagttccttcttcctacacactgttattcttctgagactgaatgcattatcctgttgcttttgcattttagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaaggtgagtcaccttcttgaggagcctttttggtattttccttcagagcacatctacctagttccttcgggtgaattgggttgggtcatggggaggggttgcatctgtgttgagaatgagttacaaggacatatttggtaggcaggaactttagtagccagaggtattaataaagtgggggaaaatattgttatagtcactagcaaaaataatttgctatctttgtttgggtggggccccatagacacccggctatgcatagaagcaatatagcatttggaatttgaaaataaattttcatggaatatgttccatatattaagtagtttttcagaaatgcaagcttcttggagcatgcattttgtgaactgtgataagcttttttatccgtcagaaataatgtgaggggagttaggaacaagaggtttttcaccctttgaaaaagtcaggaatgtggattggctcattgaagatcttggctacatataaggagtggacagcattgctctaggagttgtgatgatgtaacttttgccataaaaggatatggattttttttttttttttactatacacagtactgagtttttaggatggagaaaaatagtgaatagtcccatgggggtgctgcccagaatgtagtaaaacaaacctttgcttgtttcagcctctatctcttgagacattggagaaactaaggtagtttcaaagattattcaaaaagaggcagagccttccttcattccttctaggcaaagtagtctagacatctttaggaaatatgtccaggtctcctggaagcatttcctacctggtggtgtagaagattcctagggctgtctacgtggtgtttctctatttccctgacgtccaggaaagctgccccctcactccctaaagtgccccagggacatgggcagccctcctactgtgaatgagctgggaaccgccgccattttctcctctaactcagagtcacttgatgcagtggaactgagttcccccaagagtttgctaatcactctatcttttcctccctacatatgaaggaaatgtatacagggctgacagatgtgtatggagaaaggtttcccagccaaggcactgggaactctgcaaatggcactaacgccatcaccaggatgtcttaacctatcaagactttgtcatccagcccttagtttctgcctcaagcaaccattgttactcttcttctctctctcctttcctgcttccttgccctcttctctcccactttccttttcttcaccgtaccagtgtgttttttaagtgtgcttaggttacaaaaataatatatgcttgtaaaatggtacaagtatcagataaaagttctcctgcatattctccttagagtacaaatatacaccattctatatatatccatccataactttcacaatgcatatatgtgtatgtatatatgtatttgtgtgtgtatatatatatgtaacagaaagttttgtgtttttacattgatgtgtaaaagctaaactttatgagtacctaccatgtgtcttattttacccctattttacgaaagatgaaactaaagcaaagaaagtttaagtacttgctgaagtcatatcagggatagtgagagatggagttgaatttgaacccaggcacttcggtttcagaaccatgattaataccgtgctttccctggaagtgggaaacaaatgcttgaagcttcgcctgttgagggctggttgactggcacaggaggagaaagttgggaaggtgttaggaaaagcctgcgctgggcctctcctcgcgggccagtctgcccttgccctatactcatttggggagaagctatcataaaagagtctgaaagatggatgtgagactcaagtccaaaaaattgagaaaataaagataaaagttcctggtggatttaacaggtatagaagtatactgtgttctacagctgcctatgggtgtgcccgccaatgctaggacagtgactgacctgaccctgccctgggcaaaggctcccatatctgctctgagcagcctgagaacaacgaggccccttaaaggaccatggtgcaaattccagtagaggcaatgccccagggaaagactttagtgtcagaagaaagaaagggaagtcatacttatttttttatttagagatggagttttgctcttgttgcccaggctagagtgcagtggtgtgatcttggctcactacaacctccgcctcccgggttcaagcgattctcctgcctcagcctccctagtagctgggattacaggcatgtgccaccacgcccggctaattttatatttttagtagagacggggtttcaccatgttggtcaggctggtctcgaactcccaacctcagttgatccgcccgcctctgcctcccaatgtgctgggattacaggcgtgagccactgtgcccggctatcatacttatttattaagtgcatattatatgccaggaactttgattttctttcttttctttttctttttctttctttttttttttttttttttttttgagacagagtgtcactctgtcaatcaggctggagtgcagtggcacagtcttagctcagcctgccaagtggctgggattacaagtgtgcaacaccatgcccagctaatatttgtatttttagtagagatagggtttcaccatgttggccaggctggtctctaactccactacagatcactacaaaagtgatctgcccgcctcggcctgccaaagtgctaggattgcaggtgtgagccactgcgcctggcctgattttcagtatggtacctgatctttacaaatattctgtgaggtaaatactgttaactcaattttacaggcagagagaatgagattaatagaaattaagtaacttgccctcgctggtaactaagcactggaattgtatccaggttccactcggggattcaaactctggcttcttcctgtccttggggaggtctgttatgaggataaggtacctgtgagagtgttatgtgagctgtgacgatggaaaactcctgtgaggattcacaatgataaaaataactgatggtggtcccagtctgtagaagggtgcatttattctctctcctaccctgggctgtcccaggtttttttttatactaactttttcaaccatcctgaggtaaaaagccagtggaagtttactttcagaaacttctgcatttccttcacctttttccttggtttcccttgagtctgacctgttgattgcagctcctgaggtagccagcccacatgcagagtgaaataaccacccgggtaagacacaacaggtacctggatgaggtcacctcttgtccttcaccttgagttctgtctcggggagggacgctcttgtgaacagataagccacagtttgttgtggtgggtgctgtagctgaggtgtggactgttttcaggtgaggtaaagtccgtgatgtaatcccatcacccctgctccttcaccgaagccttcctgtaagtgagtcagactctgactgtgtcaggatctggcattgcactctcaggtgagccaattcatagactactttttcaaaaagtagtggcaaaatacctataacataaaattaaccctcttcaccattttaatcaataatgttaagtatattcacattgtggtacagccaatgcctggaaccttttcatcttgcaaaattgaaactcggtgcccattaaacaataactctccttcaccacctcccaccagcagcccctagcaaccactattctactctctgtttttatgagtgagaactctcgatacctcatgtgaatgaaatcacacagcatttgtctttttgtgtatgggacagagctactgaagaattaaataattacttataaagcactttactgcttggaaaataaacactgagaaaattttatctatcaaaatgtgataggatatgcataaaaatatggaataatataaataatgggcatatttcacttagcataatgtccccaagggtcatccatgtcatagcctgcaattcataggctttaatgtgtgaccccgttgacctaagaatttcactcggaggaattgttctaatgacatcagtaagttaaattagaatttcattattctgtcagtaagtgacaaaaatatttcaacatttagtcccaatttttaaaaaatattaagagggactgtaaactagttcaaccattgtggaagtcagtgtggtgattcctcagggatctagaactagaaataccatttgacccagctatccccattactgggtatatacccaaaggattataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacaccgcatgttctcactcataggtgggaattgaacaatgagaacacatgaacacaggaaagggaacatcacacaccggggcctgttgtggggtggggggaggaggagggatagcatttggagatatacctaatgttaaatgacgagttactgggttcagcacaccaacatggcacgggtatacatatgtaactaacctgcacgttgtgcacatgtaccctaaaacttaaagtgtaattaaaaaaaaagggaattaaaaattgtaacaggcaacttttcaaaacccatagagcactttatgctttgtagggaaatcctaaagaatttatcttaaaatcatgccccctcctaccatcatcactgaatttagttctggttacacagaacaacccactgagacatgaagctaaagaaaaagtgatagtatataatacttcttagctagaaaaggcctagagactcccatgaaattcattcacttgttccataaggtggtgaccaagtacacagttcatgtataaaaaacaaaaatattcctggacagcaacataacctactagttttcccaaagactgatctcagattttgcctgtgaggtttggaggaaagtctgcagaacctttaggaaaacctgcaagttgtttgttgtatcatcattgccatcatggttagatttgcctttgatttcgttttctctctcctgcaagcagcaatgagccacagctgtgcctgacctgtgatttatatatatatatatatatgtgagcagatttgcccgcaggaagactactcacttctgttgactccaagtggccctagggctccagaccagaatcacagattttcaggggcaaagaaatagctgtctttttaaatatttgtgatattacgtgttttctcttcctgtcctctcacatcctttgaataaattaacactgcctgggatctagtacatttctaaagtatttggtccatattatgaatttgaaacatttggtattcctagactgacttacatgcatatagaagatactttcttctgaataatacggttttcttcattttacagaaagcacatcttgattttcgttacaaaaataatggaagatattcaaacaacatagaaatgtattcaaagacaaagaaccctacatagccccacctcctagattagccactgtttatcactttgtttatattattccatattttatgcacatatgatcacattttgacagataaaattttcttagaaagtgctttataagtaattattcttcagaagctctgtacccgtacacacattgatattactttcaaaatcttttaaatgaaatcatgaagtcatggacagcctttctcgtttgtgcacataggtcattctttcttcctaatagtcacataatattccattgtatggatttaccacaatatcgtttaatcactttcatttatgttgtttccaattttttgatgttttaaatagtgctgaaattaatatccttgtatgttttttacatgtatataaccatttcagtgtaattgctgtatcaaagggtatgcatagtttccttaatacttccaaattttgctcccaaaagattatacctatttatatacccatcaacaagatatgagagggctactttctctacatacttgatagcacttttatcactgtcttcggcaaaaaatactttcattcttttgaaatgaggcaaattattttaagaagctgaaataacaagaccatttgataaaaactggacttgtttactgacactgctttgacaaccagttgccttaacatagtacaaaaaagcacttgagtttgaggtcaaactttctactctcaagatacttctccagactcagtttcccctctgtgagtctgaggtcctccatcactaaaccaccgtgaggtgtgaatgaattcttcagttggcgctggctattgcacctcatctgatgggagcgccatccgtgatccatgctttctggtgggtttcctcctctagtttttgttctgtgtcattcccttcctctttgttcactccttgtcatgagcagaagagaagagccagacatggctcgagacagaattttataaccttcagcactatgtcatgtctgagtaactttggggccattgatttagaatctctataaacatgtcactttatggttggcaaaccaagttatttatctgagctggtgattagatgtaaccatggaaaagttgcccacgtcctgctattaaccaggattctgacataaaattacaggttagactagatgaaattaattcagtcatccaagtcatgcagacaaaagtacagttggggtggcctgtttcaggttactttcttcatttgttcatttcatcatcatttatagagcacttactatctgtccagcactggactggttgtcgtgacaggcagaattgagacacagactctgcttcccagggactcacagtctcagagaggaatgatgctcacgtgttctataatagagagaggctcaaagttgtgaggaaaaagatgaacatagctgggaagactcagggaggacttccgagaagtgatatcatttgtattgatttccatttcaaaatttttgcttagagaaaaggaaggctgggaaagaatgacttgtcctgcccttcctgatctgggtgttaatctgacagcaaatctgctgggttcactgtgttattcaactcatattctatggagggcttgtagagtgtaaacttctgcaagatcatttctgtggtggggtagggcctcccttggtcatcaagagatctttgtcattgctggagctattatcccaggccagggagagcttaggtgtcggttggttagagtgggtgatagccatctttttttgggaatcagctgtgatgttattatgaccttctagctagtacccatagttgtcaaagggcttagaaagccaacctagaggtgtgaaccaaggtggcatcattgaatttaaagaattctctgggatattgcctggaatggaactcagtgaccagttagaccacctgttgaggctaagtaggcaggatggattagatgctgccaaatttagggacttcacagatcactggaggaataaacaagaagttgtatcaaagtctcggggccagtgttcagttatctcaggagaggagttttggggccttgcaatcaaagagaatgcaagtaccgtgaaggcagaccactgtgtttgagtattggctctgccgcttcccagaagtatggctctggccaaatgtcatggtcaccaatgcatctgctcaggatgaccctcaaaagaccatcacaggccatgcttagcaccattctagtgctgtacccctgcattcccaggtaacagctcaggtgtgagggaataagacttgaatagggcaggtgcacaagtccatccagcttaaaagtcacataccccaagggagtatgtaacagccccataagtataaattctagggttcccacaaggattaggcccaatcaattgtcatagaactcagagaagctcaaaatgatggtgtcctcaggaagtatttatacctcatttatggtttttcccatccagatgtgtcatttttaccataagcaatgtgcttagtaatatagtgggcattctatctttatcacatttccaggggaacagttagcaagttaacccaaggtcaaattctcgtccaaaagaggaaagggttttgttaatccttttccaacagcaagttatcttacctctcagagattcagttgatttatctttgaagtggcaacaggcttctatagccctaatgttgggagaaagttagatgtgaagcattctttctcattttttgcataatccaattaaaactctagactgttgtctctcaaggtgtgattcatgagccatctcatcatcccttgaggtaattgctaaaaagacaaatccccaggcattacaaactgagtccttctaattcatatttttgaataaaagcctagaagtttacatttcacacccatgagatcttaaggcactggagcttgagaaccctagttttagcaggacttcttggttacctttaaaagagaacactgcctgccgggcatgatgactcacgcctgtaatcccagcactttgggaggctgaggcaggaggattacttgaggtctggagtttgagaccagcctggtcaacagagcaaaaccctgtctctaataaaaatacaaaaattagctgggtgtggtggcgtacgcctgtagtcccagttaagtgggaggctgaggcaggagaatcgcttgaacctgggaagcagaggttgcagtgagccgagatcacaccactgcacttcctcctaggcaacagagcgagaaaagagaacactcccttttaattgccctttaattctcaacaactactttgtagtacattgttatggggaatggaggtaatatagtaagacacccagacaaatgcctagcacatagcaggagattaataaatggggaatcatttaaatgtatgtatacattttgtcatatacatattgaaatttattctcagaaccagcaacttacactgggtagacttaactacttgcataggtcttattttcttttggctttgtgctattgcctcactaacctttagcaaagttctttcttgcatttttcatttttacattttcattgctgtcttgtttctgctaagctaacagattcttccttagactggcaatattaaaaagaaagtgtccctttgaggtctaaatagggaagcagagggaatacaagacaaagaggtgctctgagggagaagttggctcaccttgccctagctggagaatcatcttttagctctttgtctccttggcacttgcagagcttggtggtactttatgtggaggagagcactgtcctgttcagaggaagggcgagcactattaaagctgcctagagaggcacctgagtgacgtgcccaactgcccttactccaccctagcttttgtccttaacctcaagcattacagtcaaacatcaaggtgaaagaaattgtatccagtgcagtcttttgccccctttgggagtcattttcttgatctactgtgtaatttaaaagagccttcagaagaggagacacaaaaatccctctaatgtgtgaaactaataacctttaatgctgaagccatccttttttcacagagaagaagaatgccaccatgtttgtttgtctctaaatatggatacatttcaaaaccaatgtgtgaacttatggttctgctatatatcctttctctaaaatacaataaacctggctttttgtaacaaggagtagagaaaaagagaaaatatatcatttggaaagatgaaagatctatttgattagtcttgtctcaggaattgaaaatgactagttgatgttcatccgatcttcagatgataaatctcagcatttctcttgcttccatctgttacgtggaaactatcacacatacatgaattcagtttcatttcaaggatcattgggagggagaagtatttacctttctgggtgctctcataatagtcatttttatcaagctctcatctgtagtcaggacttagttcggtcatcccttagtttaaggtccgctttaaaagtttatgtcctccaagtttaggtatttgacagtgttcaacagcatgagaagatacatatattttgggataaatgaaactaacatttctgtgagcatatgtagcccatgttcacaatgtgaagtgcaagcatggagtgctgaggagagagaccctgaacagtaaagcctggcagctcatgtagctgcaactacttactgaggagtttcttgtgaatgtgcacttggctgcctctctgggccgaggacatgacatcctcaggcttcagtgactctcgcaaataaagtgcttgtttcttagctgcagcttgcctttgtgattccatcaacgtgtgcatttcattagggtaccagtgtgtagcccacgtgccagggagccgtcttctcctgatgaaggtgtcggggttgcaatgagaatatttgagacaatggtcatggtatatctacttggtggtgagagtgacacatgggccatttgcaggtgtcacaccctgtggacgaatggtcatgctacacggtggtttgtgccaaggcctcatggacacagttcacattcttagtgtcctaggagctcctgccatgattccttagcagtggttatgcttgtttttatgatggcaaggctccccaaactttgtggacaatgcacagataacaactgctgatggaaatcaatggcctggcctgcttccttcataagagcaaaggtaaaggcagcctcttaacatctaatgctccctttgcctttttcagagttggagaatcacagcatttttctgaaatgtggagtgggaaatctaaatgtggagtggggaagctataattacatagcttggaaaaagaaaagtttaagaaaaaaaaaaaaaagtcctttggctccaggacagcctaggactgtaagtcactgctgccccctactgcccaagttttgtgtgtgtttcctagaggatccttggtttctagcctggcattctcaggcactgtgcttgggaggataataacttgcagactgtctaaatgctttcttccagacagggcctccccacatttgtttcctcaatttaggagaatgtatgtgaaatggagaaaacccacagtgtgggtgtgatcaggttcatgtggcctagtggaaagactttctcttgagtggtgaggaactgacagcaggcctgagctaaaattggtcttcacaaagccgtccacccactcacttgggcaggcagccagctggtggattcaaggatcaggtttagccctaaggagaaggatttttgaaggcactagttgatttttgctgcaaaaaggttatgctagatttggttccatttttaagaggcaaataattctaaaccagactgtatagtgtggaataaatgattctctcccttatttattatacattcatgtacttggaattcagtccttcatatattcatgtgtctgaggttatttattgaatgtcttctatgtaccaagcattatgccagtcactgagtattcaaaagtgaaaaagcagattatttctgcctgcatggaacttaaagtctgatggaagagacagtaaacaaatgcaaacagtatcattacattttgtggtaactggtcttataaaaaaaaaagaggggtactatgaatgaacttaattctctggattaggtagaaacttaattctctggactaggtacaacctcttcagggtgagacccatagccaaagtttgcagggtccattgtgcccatgatccccattctcccacacaatggttggaaataaaggatgtttttgaaaacagttttatggacagaaaccagttcccttgcacaaatgaagatctatatcctgaactagcttttttcttctctctctggacatagggagtaaaagtaaaaaaaaaatacagggaggcaaactttggctccatatgtatattgtgaaaagaacttttcacatttgtcttctcacagttgaataggctctcttgagagtagtgagttccctgaccccagaggtattcaaatagaggctggaatatcacttgctagggatgctacaggtgaggtttcttacaatagccggtaggttggaatagattttctctcagattgcttgcaaatctagcatttaattaccccaggcaagggtaaagttggtgtgatttgttctggaagagtctcctccacctcagtaatttcacacatatccccacagtttattagagttcccaaaaccccacctttggattggttcccttaaaagtattcattcattccaaaaatgagctttatttttgagggtgctacttgtactctaggattcatttgtatgctggaaaaaggctgcatcttacgtggatatgcctgtgtgcatttgtgatgacctcttttactccattcacattcttgagaagatttctcccttaacttcacttaaattgtcttgaacttgccaagttcatgctcagaggccatcagagagttcacaggcaaggatgggtgccacacagaagaaatcatggctacttcatgagaagtcacatgtgtggtttccaccatttaacacttggataattccttgccctcatctaagagccagataggaatgttcatgcaaattattttttaaaaaatctatttcactgacatgctgtagggggcagtattcattaaggaaaaccagggacagagtccaggaagagccagtaatttcgaccttgtagggaagaaactgggccctatttttaactatttctgtatactagagactcattcagtctgtcctattgttcgtgcatgaatgaggctctgaccttcagtaatgaaccttcttagggggccaggattaatttggcttatgttaaattcatctggcttggagtgaaaaccagtgaatacctgtgagggagagggacttttccatataggacatatgtgctagggcaaggattcttacctaggtcacctgactccaagcttttgctcttttagccacaatttgaaccatttcaggctcataccttccaacacaagtagtgtttacctcccccagaacatcttcaaacctgttactgcctaggaaatagataataataaaacttgtgggagcgaacctttttttggaccctctcaccttgataagtttggtgaagcaggtgccttactcacccctatcttcccagcccctcaaaatgaatgttttcaaatcatagccacgtatgatttcttacaagcccaaggctgatgggacggtcttgctaaggtgcaccagcttcagggggtctcggctgggcctgctcctatgtctgagggcatctggcacattgactgcatgctggctggtctgtaatggcctcaggtgagacaactcagaattctctacatggtctttcatctcccagcagtctggtctaagctattcttctggtggtaggtgagttcgaaggcagagagttgaaatgtacaaggccctttgaggcctaagctctgaaagaggacaccagtttttgtcttcattctgttggccaaacctagtcacgtgacctgcccaaattcttgtgattgggaaacagattccacctactgaaggaggagctgcaaagtcacattgcaaagcgtacatggcacagagaggggtggacactaggggctgtttttgtaatcaatctaccacaataaacaggttgcacccagtgaatttgtgttgatggattgatttcagttgtcaaggtaatagtctctttccactgtagttgcatgaaaatgagaatgcactgagctcatttaagatgtactaagacatacttgcagtttcctataagttataggggcatgtagttctaagaactcacgggggagagcagccaaagcatccttggttaccccagtcccatagaaggtgtctctaagaagcagatgctggcaggtcggtgaaggggcacaagcaccacttgctttatgaggcccctgtggccaaggaaagaaggtaggaaccagctgttaaagtagaactccgcaaaacaggtcttactccacttgagtctgttctccagcctttgggattcttggtattcacaggcctacacttctctgctttctctttcccacaccaactggcaaaagttgttgtgtgatgaagatgatccaaatgtcagacttgggctcaggacacctggggtctggtcccagcaactctatttgatggctgtgtggctttgatgggtcatttaacacctctgaacttcacattcctcagctctaaaatggaaatgaggatagcaccaaccacataaagttattgtacggtttccgtgagatgaaaccatacagaaaaataccctaaattgtgtatataaggtttgttgaatcaatgatttcataagtgtccaaaagtcagaaatgactacaaaggggaaagtaaccacagcagctgaactgagaacctcagagagccagttctccactcctggtctgttgcttcagatcaaaagtctgaagcacccctgtagccgcctcttcttgctcatcctcctctctctctgataaaccgtgatgaaaagtgtttttgaaaaccaagggaccaagaaacactgaatgaccttcactgaaaggacgacttttagcaaatgcacacttgacatagtttggtaaatatccaccctgttatcttttgctcctggtgtcttagaaatgtcacttattgattcttgaaattcccccactgccactcatagggggagggggaatttgagacagaagtattgattgaaactagtgaacactgaaagaagcatttgttaggtggtcctttccttttttataaattggctaaagtagacgaaagaagatacatcttttggcggagttttaaacaaaaggaaattagccaattatattcctataaaacaatgtttgaaagtcagaattgattatttttccacagtgttttggaacaaagtactctgataggtgaaggatcaaaggtcttttctctgaatatgattttatttttccttttgttttttatcatccctcagtctgggtgctctgattgtcttaatgcatccagacccacaatttgcaacttgctgccccattgctgggggctggtgactacagtgtctttggacagattagaggaaagacattgtagctgaactcccaggcagcccccaggaaaggagcagggagctttctgtgttcccttcagtctgagcatgccaagatgccctggctctggccttgaggtgttagtcagcattagcacttatgatcttggcaaccggaatggccactgctggccggaaactgatcagaactgttcagtctcattaaggagcccctcagatcaccttctcagatgtaacgcttcagaaatcatcaaacggctaaggtagaggctggcttccttgaagtctttccagaggctttggcatatctgccttttggatgagcttaactaaacagagagcttttgaggtccagggtgggtgtgggagctctcagggcactggaagtaacactgtggtggggtgggaggagggtatactgagcttttcttggcccacccgttcactccctccttcctccgttaacctcttcctcatcctcactggtaactctccagcaccaggaggaggagacattttgcagagtgctggtctgtatttaataaataaatgcctctatcctctgcagcactgtccaacggtactttctgcaatgatggaaatagcctacgctctgtgctgtctaatatggtagccactagcgctacatgtgactattaagcaattgacatgtggttagtgtggatgaacgaatttttaatgtagtaaattttaattcatttaaatggccacatttgctagtggatatggtatttgacagcacagctctagaaaattattcattgagcagccagtgagtctgctgctgaagtctgtcattaaaaaaatgtcattctagacacaaaaggccaaatattgtatgattccgtttatatgaaatctccagagtaggcaaatcgatagagacaaaaaatagatttgtggttgctagggctgtggggtgggagtagaggagggatgaagagttgctagagtttcttcttgatatgatgaaaatattttaaaattagattgtggtgatggttggagaacttcatgagtatgaggatactaaaaaccattgaatcactctaaatgcatgaatttatggtatgtgaattatatgtcaatatagtggttttaaaaatggctttctgttcatgccatattcaagtagatgttataactctagctcttctaccccaaaatattagtggttaaatgtctcccctttcttggacctcagtttcccctcgataaaaaaaagtatattgattttgcatcaaggatactgaaggaaagaatttctggtcctcctttccctgtatatatttaactttaatctagttcatatgggatgggactgtatgtaccccctccttttgagaccccaattctagacagtgccccattccaggagtacccaggcagtaaacagagcattgacgcaggtaactggccaccccactctggccattccctctggaaccacagcatagatagaaggcctttggtgctggcctaggaattttaagtaatgcctgagacgtttatctttctgcctctgatccagataaaaacagattgtaactttgagttgtcaattgatcctaatgcacagaaaccactttccataccctcagtgagcaaagaccctggctggggaagaggtggggagttgggagtaggaggagattcctggctgtaaaacatctcatggttttctgtggtttgtggtccaggggtcctgtggaatctctctgggaagcacatttcttcaggagcaagcttggtctttttcttctcccacttctcggctgctctttttgaaatcaaaagcctgccatagggttgcaaattagtgacatcagacgaagtaatagttgccatcatgttcctcctcctcctcttcatcactatcctaaagccttccatgtgtgtcaacagatgttacaaacgcctgccttataaataactttataaagttatttataaggcatatataataacttatataactgcttataatataggtgaggaaatggactgtgaatagacagggggcactgaaacagtaacaacaaagaaaatggtaacagtcactgcccatcgtggggtgattgagttattatgtgcctggaggtgtgttaggtattttgcatacgtagtctcatttaatccctcacatcactactaggaagtgtcagtagtaacatctccattttataaagaaactaaagttcagagtgattaaataacgggcctacattatgcagctaagggccagtgttgacatttgaaccagaatctgcatcattgcaaagctaatattttgcttttaaccctcatgctatcatacaagctagtttttactaaattcactaatcattgagcccctcttttatgttaaatgctgtacaaattgctggaggtgcaactatgaacaaaaccagccaatgccagatgagtggtccaggcagtcagagtcatggaaattcagagaagaaagtggaagcttagggactgggagaaggtaggcaaggagagttcatatagaattggagcttaaaggaagagtatgaagttcttgaaaaactgtatagggacactgtaaatcagaggcgccctggagtttgttttctgacatatcagcatgttaagaaaaaaacataactagccaggcgcggtggcttatgcctgtaatcctagcactttgggaggccgaggcaggctgattgcctgagctcaggagtccaagaccagcctgggctacgtggtgaaactccatgtctactaaatacaaaaaattagccaggcgtggtggtatgtgcctgtaatcccagctactcgggaggctgaggcagaagaattgcttgaacctgagaggcggaggttgcagtgagccgagatagtgccactgcactccagcctgggtgacagagcgagactctgtctccgaaacaaaataaaattaaaaaataaccaaacaccacatgtaaaaatatcatgataatttgaactcatttttatgaggacaatgatcacttctcccccaaaatgcccttaagtgtaaggtaatgcttaatccctgtctcactggcttttacagtatcatcattttgcaagcacatttttttttttttttttttggtcttgatttcatttagggcaaggacagggcttagcaaatatttgtgagctggaagtgaactgtagccaactctgttggctatatggtgcctgaaatcccagcatgtgccagatgctgtgcttggaatagggacaggacacgtagcacagaaacagacacttgtaatatcctgtgataagtgtctataggacatttatgtctggaaggagcatccaatccaatcttggaggagtcaggaagatatcctggaagaagtgaggtctaagctgaaaggtgcattagctatatacaataaggaaagcgtattctagacagaacagcgtgtccaaagtctagatggtaaaaggggacatggcatgatagagggaagttgagtgtgtatatgtgtgtaggtgtctgaatgaagtaggcaaaatgactctctcaattctacccagcaaattggtgctagactccaagttttgtgagggcagggagcatgcctgtcatgttcaataaatccttgttgaaagaattgagaggacggtggccaaaatgggatcagaacccaggctttctgaatctctttggtgttttatcctgtcacctcactctaagaattcttcatcagttccaaattgacctcagacagtggatgacctagaatgcctacccaagccagtcagggcagaaatcaatttcttggtgggggacagagctgcagcaaaggcggaaagactccaaacttctgtccaaggagctttgctaataacttggttgacttacagcgaaagggagagcgcatcttgatccagtgatcggtttatttgtggacatggggaaacctgagagagctctgtggtgatgaagttctgggccacctaaattctagtaggtttcagcatctgttagcaaaaggcagccctcaacctttgagagcacaagtggtaacatctgcagccactctagcgattctaactggcaaaaatgatggattgcaggcatttcatcattgaatttctactaggttacatcctgacttaatcttttggtgcttacattctaatttttaagcagaatgtctgtgtttggtagtagttcttcaactttatctcattaaataaagtttagtgaactgccaaagacaagatgagctagggccaatgtttttgaaatagaaaaaatggaaatggaatttacatctggactctaggacactttgctgcttcatttgcagaataagagcaaaaaagtgattcttgtatgtttctatatctcttgcaaaagtcctctttgctttcaaacacccacagctttgagcaaatgtttacattccacttaaacacatttggactttaatgtctgtgctgctgattacgaaaatgttaaataaatgaaacagaaaataaaatttgtttcaaggtaatattttagaatgcctgacgccccttacccagccccatgagactggtcactgttgatctttgtgtccccataactggcacaaaacagagatgcattaaatgaaggaatgcattctttagagttcatgtcgaatactcattgtcatgaagaccgtcctttagtgtaactggaaacccttacccttgggaccatgtccttataggcatgtttcttcttctaaccctggtgtaaatttccaagagacccagactgtgccttatttctctttacacccagctaacccctctgaggaacattactgtatgtatacatcttgctcaaccagtgtgtttgcttacagactgacttccctaagctgtactgcagttcagagagaaactagattgaacagaaccttttagtgcattgtgttactaaaggcaggattaaggcatgtaatccgagttgtccagggaaacccatgcattcctggctgctattttaagaccctcctcctaataaactgatatccttcaggtttatttggtttaactcctgctctggcagtttggcttgtttctgtgcatcagagtcgccatgaaagctactcctccaggattacagctggacagctgcagaatcgctggcatttttctttccttaactctgtattgacagcaggtttgaatcactctgtcctgttttgtgtaatataaccaggtcagaaatcatttgaaaaataattagggtacctaatttgatctcattttcagcaaaagagatgcattgcctggtacattttgtattttttgtgtttgcagctttattaagaaaatcaaaggacctccctcttctgcccttctatttcctgctaattagcatgagagtgtgggggagcctttcccagtctgtaatatcccatcagccccacatccttgtatgttgtcttgtagaaacctgtctgctcattccttcactgttggccaccccagttggtcttatcttcctgtcagctgggtttctggctagctttcttaagctcacaccaatccctggcagagctcctcttcatacagagagaggcagaaatcctgcaaattgtaaactagcaaaatgtacaaatttagccagaactgtctatgtgtgcccctgcccggttataagccaaattcatgccgtgcctttgcctaagaggatgagacttcgaggcacagagagaaaggagggaggctgtcaaaactctggttccagatctgctactaattcagagtgaccttgagtagcaatcacgcactctgggccttagattcctccatcgcagtgcttccttttagttctatgtactttgatcaaacgatagttacctgatggatggtgactagctctacgcctttttttaaccctgtgcctaccttagtctcctatagggaccgcatagtctccaaaaactactacaactctggataaaaccttgtcttggcaaaacctaagcaaaggcttgatccgtggaaactgcctttaacctagacatcagctgtggactccccgagccagtgttattgctggagtcagctcctactagcacatcagagcgaattttttaattttcaggagttttgcaagcctgttgatgtcatgctggtagctagacatctgccatagcaggagtatctacaccacaggaattggcaaacactatgaatgagaacttttcttttttccctccagaatcaattgttagtcatttgccagccattaaatgtgaattggagaactcacatgtggaagacccagtgtcctttttaatctttttggaagtgtttccttttgcttattttgttttgttgggagaaaggtggtgtcacattactgtcggtcactatttttgcctagtctgttctgccgaaatacttgcacttacaggtcatgtatcttcattctctgtgtaatatccctctcttacccatgggaaccaccccaaatcattctcagaaaagtgatacaggctttgggcattgtggactattcctgaatgtttagggccttggaggggttatacgattgcaatacaaaccgcttaaaatttaatattgttgttcctgttctttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgttgttcctgttcttaaaagttcttcagctcccttgccacttagaatttctccatggccaccttttgttttgttcttaatattccagccttctgctatattgttcagccatgcctcccttctcctctcctttctacttttctccccttctctcctctttttatacagagaagtttatctctgttttcttatctcctttcagaacatacccttaagagctttgtcttccacagttggagtagcctgtccaaggttagtcaaagttggtgcacagctttgctgcactaatccagtgcattcatgtggtacatatttgtggagtcctgactttttctagccactgtgctttcaaggaactcagttgatcatggagtccaccaggatctaggttttcagtggggcactggggagaaatcccctgtcagaagttatctcattttcgtaaagggaaagatgacttgtgttgagaagagggaaattgtagccaggtaaacttccttcacataaaatttggaacaccgaatcaccatttctcctctctctttaattatttgaagactcttcaccatggcctataagactccgtgagctggcctcatttttttgctgtgccctcccttctcactggaagcttctgccatatccaatagtatgtgttttcatgcaaaggccatactctcttataatcggcctctgccactgcagctctccatttgaaatgcattccactttcctcatccttcttcccaccaagtctctaactcatcttttatgttttaggttagattttgtttcctctagaaatctttccctgacctctggagattgagtttgaagccctttctctgagttctcctgcaccctattctcctctctagttgtcctccccaggttccgtggttatcttgttggtccttcatgagcaggttagctccttgaggtcagggactgagcctcattttcttctctctccattgccattacaggacttggcatacagagacgttaaagtatttgttaagtactttaatatttgttggtatagtgaataaatgagtgagctatagagtaattatttacagctcagactctggagccacacagatgtatacctgtcatctgacattggacaagctacttagtctcttcaagcctcagtttcctcatctgtaaaatgggggtatagcagtatctacttcatagggttattgtgaggagtaaattaggtgatgcaagtacaatacttagcatagtgccttttacacagtatatacttaataagttattaaactgttaatgattaaaatcatgaagagcaaatgaaaaggaaataaactaatgtttttggtatatgtaccaaaagccagtaacatccaccatttaactggaagataaattatcctattcccaaatatcttccaaggctatacctgtcattttcagtaccagatactaatgttcagcaatgcagcccaaagcatcacagggttttcagttagacccaattttactaagaaagagaaatagaataacatgcttttgaggaaaaaaaataaaatcagtatgcattaatacataaaagttgctgttgctgttaactggcttaaatagaaaatatggctaactagaacatctcttttcagtttaaaggatttccaattagtgtctttgcagtaacaactgtgttaaattgatctaatcgtgtctgtctaacccttatgcatgcattcactcactttatcaaacaacatttattctgtatcacatactggagataaagagatgaatgaaacagagccccaggctttaaggacttgatattctggagcaagggatagcagactttcttttaaatggctggacaataaatattttggacttcgagggccatggggtctctggtgcagctattcaatatgtaaatgaatgagtacggctgtgttccaatcagattttatttacaaaaataggtggggagctggatttggccttcaggcccaggcttactggccttcatcctagaggagtgagttaagtctgtagcaggctactgataagtacagagggccaaaatctgtgaaggatagagaatggggagatgagaagacaatgggttaggaaatgggttatggaactgggggtactttgagaagtaaaggagaacaactaaggccaggaggaagaaatgcatggctatcccttgatgcagaagcaggcaatgctggtgtaactaagagatcaggtgtcctggatcagccctgcccagcctagatgcttcaagaacctacctgccttctggagatctgattggacagtatggaacctgcctcaggatttctgtgagttcccatgaggtgctgcctccagcctttctgtgaaggtggtttctactccactcccacattctgaacaagaagcccacctccttgctggtttccaagagatacgcattcacagcaagcatttcatatttttagtaacttttgtgacagtatattgttgagggagggggtgtcacagggagggaaatattgcacaccccatgttccctagcaattttctgccttctgtaaggcagttgctgttctcctagggcctgagtttctgggccaggtggcttctcaaggaattattctactagagacaactctcccctgtaactgaaatgtcgttgcccctcttaccctcacagacagtggcttccaagaaatattctgctatccccctctcatctcacatctacctcatttcatagctttgttctcacaggtctgtttttgtttttgtttgagacagtctcactctgtcacccaggctggagtgcagtggcacgatctcagctcactgcaacctccgcctcctgggttcaagtgattctcctgcctcagcctcccatgtagctgggattacaggtactcgccactacccctggctaattttgtatttttagtagacacagggtttcgccatgttggccaagacaagctggtctcgaactcctgacctcaggtgatccgcctaccttggcctccaaaagtgctgggattacaagcgtgatccactgcacctggccaggtttgttacttttcacaaaggagaatgagactgaggcaacaggctatagcttccccattggacagacctggatttgaatcccacctctaccttctccagctttttgatatcaggccaatgactcaacctctctgagcctgaatttactgttgtgtaaaataggcttgataatcccctcttcagggagagaacctgggtccatcaagcccagtgcacctcagtgtggagctaatgctggttgtcttttcctgccttcatcttctcctttaagtcccaaactgagaggataacattgcattcgggtctgccattcatttacatctttagtacaaaatgtgactcttgctggagaaagtttgccatttgtctcaaactactggtatctggattgacagctgggagtggttgggtcaatagtcagtttgatattatctgaaaccatcaactttgcttctggcttgtcagccaaatttggggaaaaaatgagagttgagtctgcatgcctgtttttttccatcatggactgggaggtgacttgtaagcattcttcattgtggaaataaattcacgacgtgcaactgaatgaaaaaagtatatgcctgctgtgtgagcagagaagaacaacattctggttgagttatatgtcccatttttcattatgcttgggtggaatagatatgcccctggaattcctggttatgattagtatcatgaatgtatttggctgaccagattttgccctgatcaagtgcagaatctatatattttgttatcttgagtttgattttaatcactaggcatggaccccaggacattttatttctttttcctactttgtaaaaggtttagttctagaagtttcatgcagtcattcagtgacttgaatgaattcttgactcccacttgccctcggactgagttaggcaaccccttttgtgatccacaggtccgtaaaccaatcatcacgatagcttcttgctttgtccttccttctgctttatgctctgtttcatccccaagacctggaaccccttgaaggcatacaccatatatccattgctgtatccctaacacctgggaaagtacctgaaacagaagaaatgtcaaaagaaaaataaaagttggaaggatgggatgagatagggtgattggagaaaaaaacatgcaacgttgtggttattttaggattccgaagagaaatgtggccaaataactttgagcccagtcatatccctggttcctgtacatccagaattcattattcaagatgacaaagattctctgaaacaaaatttaataagcttgagaatgtttaagttggaattaaaacctccaagctggtctgtgagtgagcctggtttccgtgttctatctcgtagccatgcacgtgggtgagaagctccttgagtccttgttcaacaaggttcatatgaagagctctttgagccttaaggaaacagagtagatgttgccaagagtgactgagtcaccactccagacagtgagaactgtgtgtttactgggctgcttccagtcagcctggtgaagttgacggggcacacaggccaatgcctgtagggcacagggccctggctcagagtgggaatatggcagaggtcagcttgggcagggccgtgggagccacgtatgaaactatggcactggaaggacagttctccctttctccatagagttgggttagagacctggtcccatcttgcttatgaaagagaataacgccaccaaaatttggtgtagctacaccttgctttaagaaagcccaatattagtagagaagaataagaattaatctcaggattttgcagtttgcagtgtgctttcacatcattgcccttttgctgctcatgagggaggaagaaagctttagtcaccatctccatttaataaagtccattgattaagaagagcatggggccagacacggtggctcacgcctgtaatcccaggactttgggaggccaagacaggaggattactcgagcccaggggttcgagaccagcctggacaacataatgagacccccatctctacaaaaaataaaaaaattagccgggcatggtagcatgtacctgtggtcctagttacatgggaggctgaggcaagaggattgcttgagccctggaggtgaggctgtagtgagccatgtttgcaccactgcactccatcctgggcaacagagcaagaccctgtctcaaaaaataagaagagcatggactttattgttcaaattcttactctaccacttattagccatgacttgggcaagttgctaatgtctctgagctgcagtaaatccactgtataagatacttgcatgaattaatgaaataattaaataaacctgttaaattattatttatttatttgagacagagtctccctcttcacccagactggactgcagtggctcaatctcagctcactgcaacctctgcctcccaggttcaagcgattcccctgcctcagcctcccgagtagctgggattacaggcgtgtgccaccacgcccagctaattttttgtatttttagtcaggacggggtttcaccatgttagccaggatggtcttgatctcctgacctcgtgacctacccaccttggcctcccaaagggctgggattacaggcatgagtcaccgagcccggctaaatgaaattatttaaagcacttagtacagtgcctggtacagaggtggcattcaaaaagtactagttattagtattagttttatttttacttatgaataaactggagcttagctagactcaagattaccaagcctttaagttggacttgaacccattcacaaagttcgatgattgcataattctaagggtagtctgaatatcacagaacagaataagatgattatcttggcattctttccacttcattataattatctgatttttaaaggtgtcttagccttacaaaaaattgttaggattcctctaaatgggtgcttcatttgcaaaacctcaatctaccaccaacttgtcacagccagacctattacataaaataaaacagacacgtggaggaaattgtttcctgatttaggtgagtaaagctagtgagaagtcttttgaggcattttctatctcactatgtttcatcttttcagaagaattctgttttcccattaagaagacaactgtcaggtgaaaaggcccagaaatctagtagggctgtgtgtggatcagtcacatccgtgaagccctgaaattgtttgatctatctgatactaagtgtctgcattcttggcagaatcaggataaatgactccttttttttcttctgttcctgcacatttggcataatacaatcatagagagtgaataatagtccaattcagctctcagtttctgcattgattcctccagagaaatataataagctcgttctttggttggctcctgattttgattgacagaaaaaataacagcagaaagattacattttgccagcatcctaaattttgaagaacaaaaaccatatttaaatgactgctaaattgtctgacgttcctatttttaaaaagaacctcctggagggaaacattgtctttgtcttcagggaaggagttaaaggtcaacaaactttgttgtaaagtttctaaaagctgttgacagaaggcttgatgaaaatactatatcttgtacccagagaaaagcacatattttgagagtcctgtttattgtcccttctcaaggtggggtagactagaagtgcaacttacatgtgtggactttgaaataaagttgcctagctctaatctgttcgatcttgggtaacttacttaacccctatgcctcagttgtcctcactggtaaaatgggatcattattacctacctcattggatttatagcacgaataaaagaagttaaaacaataaaaatgcttagcactgtgcctggcacaaagggcatgctctgtaaatgttgaatgttatccttcttaacatgtgttgttagtaatattgctatatatgtgtgtgtgtgtgggtatataaatatattttgccatggaaaatttttgtccaataaaatcttagatgtaaagagagctgctctggtagaagtggagcagagaatatataaaaacaggctgactcaattccccttttccacaattgctgtaaatactctctgacctcaccctcttcaactgtccccaagattgctccagggaaccccagggctccccctaacacccactgctgtaatgggtcctgggtctctcactgtccagacactcttgttcagaatggtcctgagtcatggactgctctggcaggtgttgctgtaacttttttttttttctttgcctcccagtgtctttgggcagaaaaattgaagggaaaggaaagccaccttgttcagaagagttcttctaccgttgccttttccttcattgtctgttctctaaagctgagggtctctgtcattttggccactcttccttgagcatggtttagggtcatcctcgtcctttagggcaaactatagtttctcagtgtgtgttgtaagatttgaactctattaacacctgctttttgaacttcggtatctattacagtcacctggggagctagttaaaacccctgctttttgagtccctccccagagatactgtgattttgtaagtttggggtagagccagggaagctatgttacttaacaaattccagagtcccaagtttagtagcagctgtggcatttactgaatgtgagaccttggagaagtcattacctgcccacggttctgttgcccgctttgagaaaagaatgccttaaagtagctgacctccaagaagcctttccaggtccaaaattctaagatttcaccattctagctgtggtctgggctgtgtgcagcaaagcaagatcctcacccatcttgttctgaatgtcattcctgtgttaatataacccaagatcccatggattttcatggcagccacgtctctgtagtgagtcacagtgaacctaactgttgatagaaatctttttaggcatacttctgcctggtagtaacctacttcctattttcatgtagcttttgacctccatgcagagtaaataaaagaaagcaggtataccttatgggtgtttaatgctcgaatgcatgaaagaatcccacattttactagattataacatcacagggggaaataagggctcatcttcttctccctttttaattgtcctcgtaagtggccagtggacatctgtcttttctgatttagcttgtaaacccattttatgcccccttcattaggacagtgtttgtcaaaatgcatcccatgataggctttttctttaaactatcccataaaatcagttccctggcaaaaatacatttaagaatcacactatcatcccattatcctttaggatattctcagtgcaaataggcacattaaaggttctgagaagtcctgtagacaaaaaaaaaattatttgactactatttagacctccattttccaaacttacctgaccatagaatctcttctttcttttactgtctatttatattgttcagtggaagccattctggtttaacactgatttggaggctcctatttggggctgcccatccttgccccaatagaaagcagaaagattgggctgggctcctagaggaaggggcctacagaattccttaactaactctatcttagaaggatgtatttacaatagtgtacagccattgcattctgccaaaaagctgctggttgtgaacaatgacctcttgaaagaatgggatttgccccctgtaaagtgtgtataatctgtctgtgaaatttcatacactcttggaaaaagggagatggttttctacagccaattttgtactttcttatagccatatatggtacaagatagagaaattgctgaccaattaaagcaaaagttttctcctggggattttgaacaaataagttcaagagagagaaaggatgtattttgagggtgatgtggcttcaagaactgaaagataaagaataggcatgtcttatatttttaaaggtatcttccttcagacaccagcaaatgatccgtctccttacccagctgagtgggaggatttttaaaatttgtgtagaatacatttgatgtaaagggcgtgtgtgtgagagagagggagagattttaagaatttattctctttttaaggtgttatcatagggtcaaacataagcccagctgcatatgaatatttccagcaagttaacctttgtttagctttaccaattctttataacattacgtgggatttaagaacataccttgtaaaactgtttggagaaaatgtagtgaaaactactttggaaaggggtaattctttaaaaaaaaaaaaaaaacaaaaaaaaactggtttttagctaccagcagacaaatgaattacctcatcacccatggtttcacttggttttatccaaaataagccactgaagaaaaaggattaccttgtcacatattacaaagaaacacaactgtaattgctccagctgtcgagggcctcttctgcttcctctggggtgaaaaagtcactgagaaaaactgggaaatgtgtggttcatgcaggacagaggagggttctgtctgttaggataatgtgcttttacattctgcatatttatttttgatcaaactgtcacaagatactggagtattcatacatgacattttaagtgacccagtagagagcaaaatctccaccatgcatagaagaagaaaacattgaaagcatcaccaagatttctagtcattgagttcagttagttttagagagaactgacatggttagtcaagagggggacaagtcaggagcacctgattttaattttgagcgctgtggagagatctggtgtggataatagtttttgtttgtttattgatttttctaaccaccatttcaggagacctaataagacttcaggcattcttggaagtaagctaagtcaggtgcatctactaaccacaatgcaggataacaagggtcagggatgcttattttttaaatagtaggcattccaatgggcatgaaatggtatttgttgtggttttgatttgctttctctaatgattagtgatgtttaatgtctttccatatttttattggccatttgcatatcttcttttgagaatattcaagttttttgcccattttaaaatccggttgtttttgttgagttggaagagttctttatatattctggatatcggtcacttatcagatatgcgatttataaatattccatccggttctgtaggttgcctttttactctactgatagtgttctttgatgcacagaagtttttaatttccgtgaatccaactattttttctttggttccctgtgcttttggtgtcatatccaagaaattattgacaaatccaaagtcatgaggttttgccctatgttttcctttaggagttttatagttttagcttttatgtatagatcttagatccattttgagttaatctttgcatatgatataaggtaagaatccaggccgggtgtggtggcttacgcctgtaatcccagcactttgggagactgaggcgggtagatcacgaggtcaggggttcgagaccaacccggccaatgtggtgaaaccctgtctctactaaaaatacaaaaattagccgagcgtggtggtgcatgcctataatcccactattcaggaggctgaggcaagagaattgcttgaacccgggaggcggaggttgcagtgagctgacattgcgccactacactccagcctgggcaacagagtaagattctgtctcaaaaaaaaaaaaaaaaagaatccaactttagttttcttttccatgagaatatccagtttttccaccaccatttattgaaaagaccattctttcccctattgaatagttgtggaactcttaccaaaaattgtttgaccatatgtgcaaaggtttatttctgagctatctagtctagtccactggtctatatgtctgtctttatgatagtaccacacttttaaaaaattactttaactttgcagtgggttttgaaatcagaaagtgtgaggcctccaactttgttctttttcaagattgttttgatttttgggggtcccttgagattccaatgaattttaggatagatttctgtatgtctggaaaaaaaagaaagtcactggaattttgataaggattgcattaaccaaacaacttttaaaaaacatttgattataaaaaaaccattttattgtatagatcctcatccttattctagcttagactttctagaagcatatggaattatagacacaataagctccttgaagcatgtggatccaaagcccagctcgctctccctccatgccctctcactctcctgtctccattctttgtttgtcctcgtgccccgcttaccttctttacttctctctgtacctccagggatcctctccaagatggagttggagagaagactgtgtttaagctatatccttaatattagacattgacacagcagtgctgctgaggaggctcctccagccaggctccaagaaccttgcagaacctctaagtggatcgagacaggttcacctgcccttctgtggtctggtggctaccaggttgtcaagaactgaccaggatgactctgaaaacagtctctagctcatgtggctggagtcaatacacttaaagaaaaaaaaaaaaacaaaaaaaactagtttcaattatactaaccaatttgaatactcaagattgacaccttgacaaattttaggaaattgcagacattttcccacacccaattatcaggcctgttctccaaagacttgggagaggatttaggccagaaacctccccagggcagatttaaaaatcacagtagcagtgacaggagctgggatcaacaggacactctccctgagtgcctgttggcatcaggaccagaccaccaacatctccctaactgaaaagctggggacaggagagacctggggccagtgtccgccctcactgaaggagagaggaagaaatgctttatttatctgctttaaacagtattttcatttagaaagcattttggttcctgtcagggaaggttaaggctggttgccagaaaaaccaaaccaaactttttccctcccaaccggaggattaatactctctctaaactccgagaaaaaaaattccttttcttcaaagccatcctgtctgcagtgtttcaaatgaaacttttccttcttacagtggtttgtcagttggtggtgggccaaccttgtaagctggtcttttagaactgaggtgttccaactgcaaggcacagcccactagtggggcataagacctgtttaagggccaggcgtagtggctcacgcctgtaatcccagcactttgggaggccaaggtgggaagatcacctgaagtcaggagttccagaccagcctggccaacatggtgaaaccccatctctactaagaatacaaaaattagccgggcatggtggcaggaacctgtaatcccagctactcaggaggctgaggcagcagacttgcctgcatctgggaggtggaggttgcagtgagcactccagcctgggcaacaagagtgaaactctgtctcaaaataaaataataaaataaataaaatagccaggtgtggtggtatgtgcctgtggttccagcagtgagccgagattgcaccagtgcactccagcctgggcaacagagcaaaactacatcttttaaaacaaaacaaaacaaaacaaaacaaaaaaaacctgtttaagggctctgcaatcagcattttagaacagactagagtagcatatatcagagtttattatacataataagagtatatcttgatatttttcagtttaacatgtggagaagtggctgtttattggatggcaatatatcattcttactgtgtttttactatgtggtcaaaaattgtcacagctactattttaaaattacctttggctcaacaaggcctgatcatgtttccagaactggcaaaatatcacatactacacaaatatatagaaataaataaagctctaaaaactaaccatttcaggttcgttttgaacctagtccttatttgagccttctggtttgatttctatttggttgattacgtttttcaaaagaacacatttaatatgagtatatcttgatttaatgtaacagtgtttctcccacttcagtcttacataaaatttctgcgtgatttttgccaaatctgtgagccacttgtgttttttatttgtattttccttaaactagctcaaattttaaatctacatttaatatccatgaaactgttaatttatatatggctagttatcattttccaatatgtttctaatatatctaataagcaataaatatgacttttaaaatataaaaatattcatgtgccatccaacacaatctcatccacttcagtggcccacatatcatcatttgggggatacagatgttcaaaacattcttttatgcttttctttttcccccttaggttcctttgctttaacaaaggttcagatatttgaggaaaataacaagagttgttagttatcagggaaataagtgcttttcattttgaagaactcacgccacccaccttcccccaaactggttttcataggatactagcatttctgaattcacaagcagctcatctaatgttgaccataccttgacccagccggttttctccatcaagattggaaatcacccagctgcaggggtcgtctcagagacttgcccagatttgaatagaagcaaggctaaaaggacactagagaaatagctcatcctctttctaacaaatggggcaactgaagccaagagaggcaaaatggcatatctaggatcacgccatgagttggggacaaagttcaaggtccagcctacccacccacacctcccctttgtttaacttactatctgagaagcctgttgaggaaagcttcatgctaggagtcataggaccccaggattagaaatggacaaagaaggccaggcgcggtggctcacacctgtaatcccagcactttgggaggctgaagtggctggatcccttgagctcaggagtttgagaccagcttgggcaacatggcgaaactccatctctacaaaaaaacacacacacatacacaaaaattagccaggtgttggtggtactcgtctgtaaggctgaagctggagaatcacttcagcctgggaagtggaggttgcagtgagccaagatcgagccgctgcactgcagcctgggtgacagagtgagattccatctcaaaaaaagaaaaaaagaaacagacaaagggaggaacaggccccaaacagccactcagccaagctctgagatcactggtatgatatcctaggaatgatagaaatgtatcaagttactttgtacaagaccactcatgacttgacatacccttcatgtcataggggacttctggctgtgacatgagtgtagaatgttgatgacctggtcctcagatgccctagtgccccctatctagcaccactcaagactcctgctctagaaaccaaattcagaatcatacccaggtgctaccttttatagtcgtaatgagtagccttgaaatgcccccatgacttaataaccaggggagcccagactaaatactacatagaaattctgattctttgagttttaatctgaattttttcctgagtttaggcttaagagttttaataaaaccctaaagactcatcacaaatcctacatctctgttaccttaaatatgacttgcaaatgtcaaaattacccaccagcaattcataagtatctttatgctccagcaggctttagaacacaaagatgagtcagggcggggagtctctgtcctggaggaaatcccagaccaggggaataactgacctatagcagaagcaccacgtggtaacacaaggatcacttcctccaggaagttttcccaaactcttcagagggaattagtagagtctactaattctccagttctcatagcacctcatagagccctctaccactttttacactgttttcatggtttgttttgaggtccattgcaccctgagacagtgagttctagggggcgggagctttattcaactctgtgttcccagagcattgtataaagtagctgcccctccaaaatcattctatggaagaggtatggacggaatcctagtgaagcacaacagtaggggaaaatgtcatgtgatataaaccaggcctgagagtctcagatggccatttcaccaagacaagccaagtatctgttttcttctgggtcagttattagctacttagttggttaatttctagctgcgattgttagtgttaaaaaaaatagaaattatagtggagacatccatttctgagcaagcctcagagtagttccaagcggtaagatcacattgatccatgtacacgtggggactatgcctaaaacttctttaggaaagaggaacatacctttgaatgtgatcttgtagttcctataaggacagtgttgcaacctgcccctaagacccccgtccttttctttagcactattttttaacaaataatatagtttatttaattaaatttattatctgttccttcttgctaaaatgtgaactccatgaaggcagagatttctatctgttttttcatcgatggatcccaagtacctaaaacagtatctgacacatattaggagctcaaagaatgaatagatacatatgaatgaatatactgaatgaatgaatgaaaactttacatctgccccagatctaagttcaggtaaagggaaaggcagttttcctaggaggagtggtactcaggattggtgggttcactattatttcagccagagagccatcctctgtgatgtaggctgctgtatttcaaatggcagggttggtttgtactccaccatggatgtcatgaacatacataagctagtagaatgcgcagttcctaaaagtgctcttgttgtttaagtggctgtttacatgcattcttcatcgaaggaggtagctatgacaccatgtcaggagacctgagttcaaatcccagatatctgcatttctggctgtgtaatttaggattattctttagccctacctaagtctcagtttcctcactcttaaaataggggcaggaactccttttcacaatgtgctgagcactgagcctcctgacaccaagcaggccgctgatgggcagcgtcaagcctgtagcaaccctctaacaggccagcagtgtgggtgggttctcggagcctgattccaagccagtctccccaggaaaacatccaacaacaccccttgagttttgttagggaggattgtgaggcaccctccctccaaacccaaatccccagtaagtcaggaagatatatgtgttttaaaacattgggaggtctgctttggatcaccctggagctgtggcttccccgagcagctgagagtgaaaggaggcagttcctttactgtgagctctcacggcacggtgctcacgccccacacaggggctgccttcactcggcttcagcagccgttgacttttaaatcataaaaagccgctctatatacagtttactctgttgctagaaggcagtggaacataggtatttaaaaaaaaaaaaaagcagaagaagcagccgttaatcccgccaggcttctgggcactggagtagttgtggatgacaaaagttaattagaaacatgagcagtttaaccgaaaacacttgtgacaattggaagggcagcctctccggttggaggatttttcctagggaatcattgcaggagaaagtggctgctgctaggtaagtcatgtcattgtgagtttgcagatgcagaggtgctttttggggggctgaaggggtgtatcctgtctgccgtgcacactgggcatggggtgtgggtgggtgcgggcacggggcccagtggagacgtgctttgcctggcactttctctccaacagctgtccttccttgagagataggctgcatcatccggggcactgactgaagcagggtgctgcagtttccatttctgtcacattggccaccttggtgactagctgttagtttggagcctgccctcactagaacaattctggctctagtttggaagtattttgaggcttttctgagaaaagagtctggccagggaaatactcactgagcgccaaggggaagccttgactttcagataacctgtgtgttttctggcccacagtgaacccattgcatagattacactcttaagcaaaaaaaaaaaaaaaaaaaaaaaagaaagaaaaggaaaaaaaaaaagctgtttttaagtccaacctgaaccatgtttgcaacgtgttttggttttttggtttgtttggtttttttctgagacagagtctcactctttttcccaggctggagtacaatggcatgatctcagctcactgcaacctctacttctcctgcctcagcctcccaagtagctgggattacaggcatgtgccaccacacccagctaatttttgtatttttagtagagactgggtttcaccatgttggccaggctggtcttgaattcctgacctcaggtgatctgcccgcctcggcctcccaaagtactgggattacaggtgtgagccactgcacccagccatttgcaacttttaaaaagtgccagcataggaaaaacttacatgctttaataggctttaacaacttttgtgtgtaattattcttttttaaagattctacatggtttctccttcttttctatttttgtaattgttgtattttaatgtctctgatacattgtttgcttaaagttggataattcttgattctttcccataattgggaaacaggctatgggatgaataattgaaaacggtaggtatttcctactctctcctgcactggctgtattaacggtgcaggtgtctgttaagatttgttaagacctgcatgctttcacgtggcacatgccaccaaaatgtgatggggttggggggatgtgaactgtgcagtatggaaagcaggaggaagtcaagccagaaattaaaacctaaccacagataatccacaaagtgggcaatggagctatacggcatttgggttgggagtgattggttgtgtggccatggctgaccctccctggtcttcagtgcaggtcaacaagtatgattcaggcctcctctcttctgtctctgcagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtaggagctgccacccacctgtgctgcctgggacattgggtaaaagttcctttatagtggattccgggtctgtaagggcagaagctagactgtgctccaggaatacttaagtcagtagctaagaaaccacgtgatgaactcctaagagaagcagacacaatgtgctccagggagcagttcatacagcacaggttggggaaggaacagagaaagctgaagaagggaagtaaaatgtgagctgatcccaggatgcataggaaagtggggaccccaggccttgtagcagcagcttccctgagcagaaagcatgaaggcctaaatatgagggtgggggcggtttggtgtcacccgacagtccccagcattagtcctaacacatcccaacatacttaaaaaataaataaaataataaacacctggctcaataactaagatttcttatagcagggattgccttgaacatccagatcctcacagtccctgctgagtgctggggctttctgaagggagagggacattggggagaagagtaatggtaggggaggggctggtctagaagaacaagagctcatgttctgaggagataagcctgggtgtttgtggagatggatggatccttctgtctttatctgtcccctagcccctgtctctttgatggcacatcctcaggaccatgggagactgtgtggagccagtccacacagtggtgctgctgctctgtgtgattctggtcagcgacattgctcattgctcaggctacaccacaccccttgctgaatgaggcacatgggattcaggggccacgtcatacacatggatgagtccactccaggcagatggaagctccccaacccctgcccttaaagttcttatcattcccagagctttcactgacagtgcctgattcgatcctgtgctggagatgagcagtgcatttggccacattgcacaattggataactaatacttgtacacacaaaagaggattaatgatcaagtgtcacattctagacacgtattttacagttgtaactcaagtgcatacagatgcacagctgtacactcacactcatacagccatacatgtggacacacattaaaagtcacatataagcatggacacaagtatacattcatacataaaatgcaaaggcacatgtgcatacccgtatttacatacctgttcaggtgcataggtgcatgcccagactttcagcttgctatgtttgtatgattccccaaagaattcgatattccctctttcctcctgagctgtgttctagtggtctctgttacagttcctgccaatagctggtggagggactggcttaagtgctttcaaaggaaagccagccagcaccaggccagcaaaggaatgtcaggcattgcactccttccttttgttctgcttgcattctccttcagtgagggtcataccaatctttttaattgggagaaggtctcattttattgaatcaagtcatcagctcagctcacaatcctgagagagcaccagggcttagataatgactcagctggtctacatacacggcttttgttttgttttgtttctgttttttttttttttttttttttttgagatggagtgtcgctctatcgccatggctggagtgcagtggcaccatctcagctcactgcaacctctgcctcccaggtacaagcaattctcctgcctcagcctctcctgagcagctgggactacaggtgcatgccgccatgcctggctaattttttttttttttttaattttaatacagacaggatttcaccatgttgtccaggctggtcttgaactcctgagctcaggcagtccaccctcctcagcctcctaaagtgctaggattacaggcatgagccaccgcgcccagccatgaactgttctctgaagtgtggaggcaactaaatagctccatatgaaatttttataattccaatagcattattagtcttaaggtaatacatattcaggattcacagcttctcaatttgcattttcaaaattaaaatatgacagtctttgatcaccatcaatcccattccttctttttttgttgttcgctataatcatttgaaagattataaaagatataacctttttttatttcaagcttttctatcagaagaaaaagtcttaatgataaaaagcaaatgtctgacaaagaggaggaagaggaaaacgtctatgatgtggatctgactagccccgtttttacgttaatgcccactctgggtaactaacgtccttctgtcccctctgagttgccttcatctttagggtagtctgggaagtgacgctggaaataagagcaccaggatacgaatcaggacacctgggccctgtcctttatcagcccttggtgccctctgaggtcttcggcactggctgcaggaacaggtattgatcgagtgtgggtacagagtccgctaagggctttccacatcttagctcacttcattcttcccacacctccatgagctagcagcttagaggtaattaagcaatttgccccaagtcacagaactagactagaggggctcatgtttaaaaccaggtgtaggctgggcatggtggcttacacctgaaatcccagcactttggaaggtcaaggtgggcagatcacttgaggtcaggggttcaagaccagcctggccaacatggtgaaaccctatctctactaaaaatacaaaaattagcctggcgaggtggtgcacgcctgtagtcccaactactccggaggctgaggcatgagaatcccttgaacctgggaagcggaggttgcagtgagccatgatcacgccactgcacaccagcctgggcaacagaacgagactgtctcaaaaacaaacaaaccaaaaagccaagtctgtctaactagtgagaccaggctcttaaccaccagtcttgactctaaatcactttatctttattgtcttcatctggaaaatgagaagattggattagattagattctataaaatggtttattctccttttctgctctaaaattctctccctcaagcttatggttcactatatataacttataattgctccccccccgcccaccaaaacctctccatgttaaagttgttaccaaggagtaaagggaagatgggtcatttttttaaaaatcactcagaatgaattatatttatcaattcagaagtaacagtggattcatctatcactttatcactttatagtttactaagagttgtgtgtcacatcacctttcatttttatagaaccagaggagattgctattattatccccattgtacagatgaggatgctgagattcaaagaggtggagtgacaactcaagttttgcatggctaacaagttatagatcttagacctggagctagtcgaatatttagacttccaagtctaatgttccttctagtacctagcatcttctgagacttaaacatttcttatttatccagtcaacacacccttcttgcgttgcctgtgtagcatatgaacttgaactaacctttgcctctgaagagctctcaatctagttgaggaaagatttacattttcgccaacaggagaataaggagagtgctataggatcacattttagccaacaagagaataaggagagtgctgtaggaactcctggcaaggagtcaaggaaagctctcaggaaaagatgacatggaagctgcatcttaaagacagattagcagcgaactaaggaaggaggagaagggcctttaggcagagaggttgtagttactgcaaagataaacctgttaaagccatgtggagagaagccacatgtgggtgcagcatagtagagttgtatgtaaagagttggaaaggcaggagatggggctggaaataaaggaagaatgtggccatcatctaccacaataaggggtttagaccttattctgtgggtaatggaaaccaccgaagacagtgatgtcatcacgtcagtattacaaaagtcaatgaaagatcgtgtggggagtagaccaaacttaggaagagtgtagaatggagatcacagattcagatgcctaattggcctctaaatggtcatctagatgggtggctcagggtgagtgggcctgtggcagagggagccacgcctctttagagggtgcagccaccacttggcaccagcaggtggcgatctgcaataacaaagacagtcctttccaagctttattgtttttactggacgaaggcagaaatgcagatatttattgtgaaatatcccgatttttaaatgttgaactaattttaaaactttaaaatattatgcagaccagtaggaataagttgggctggtttccacaccgggctgccatttgtaacctctaggtgtgaggtacctgtttcaaagtactcataaggcctcagcagagatgatgagggcttggaccctggctggaggtgaaaggagcacagggagtatgaaatcctttaaaggtaaagataacagaattgagaacgatggcctcagtaggaagaacaaaggagggaagaacagttggatgacttgaggtttatcagtacatcccccgtggtccattctcattctgggcaaacgttttcttcacaggtagtgaaatcggttgaattagttcagcatgccagtgcgttaataatgttacatgcagggtcatgcatctgagtgtaattatgcatttgcatgccatgcctgaatgagcagaggtagctgtgacaagaaaacattgcatgaagctgttgcttcaatttgcttgacaaataagggcatggagagggtttggggaagtacagatttcagtcaagtgttgaaataatgatcaatgagacctttcatgtcagaagaactaagctctgaatcagagacctggagggcaaacacacctgcttggcacccacttccgactggttttatggtcacctttatagagaaaaccatgtcaggagaattttggggtgggggagctgttaatagagtcatctttatgtttgacttgttggcatggctggttacttagaagctgttctttggcataggttaaattattcaaatcaccccgtaccctccagcatgtgtctggctagacctagcatcctgacggaggttcagagaagcattccccagtgagggattgcagaccctccatctgggcaatgaaaagtttatcttttacagttcagcggctctctctgttcttaggacattgctccacatacggctaatgaattatttagcgtcagtctgctggtccactctgttctgaagcttcttgctacaggaggtgatggtgagggctgtggttagaccacagtggtccagatgtggtagttgcctctcatgacaagtgtgtctgcttcggtttgtgtgtgaaggtctcagacggacactgaagggaatgttactgccgagtcaagctcaacaggtgtgagcgtggagcccagccacttcaccaagactggacagcctgctctggaagaactcactggtgagtatggagcctcagaaatctgtgtctgttggtgatgaggccttccacgcaatacctgctggaacagcatgaacccagcttgattacgagttgcattatgtttgcattgactttgagctaaacaaactttctttctttttttttttcctattatttttcttcttgtttttcttcccttttctctccctcttacagtttcttccctcctccccagaatcgtaaacaagtctcttactggtgtgcaaatcctatttttaagatacgttcagttttattcatttaggggctctggactgcactgatacttaactttgaatcttcttgtttactcttcagataaagttgcttttcaacaagatttagaattctaaaatagtggatttcgttcctgtatggaagcactgatttaaaatatgttcttagagtcctatgtgaattgggggggaaaattgtaacatgcttctttttaccagaaacaaaaaaaaaatataaattttatttaaatgtaatgtagacaatgatgattacaggtacattatactgtatgacggcataaaatccacagtcgttgtatagttaattctgcaagcatttatttttggacactatactatcgcattcttaattaaagaagaaaagtcacaccttaattagaattcttactacggtggattccaggctgctatcttctctgtctcttttccccattccaaaactctgtgtcccaagctccagcagcttctagtcagggaaatgagtggtaagccatggatttattagtggctgtgtcattcttctcatatcttaccacttccacagtcgggttaaaaactgaatccaggcttaaaatccatttattgaactgaatatccctgactacagcattttaatagccacattacagctgtggaattggtctgcagcccagtgattgaaccttacccatctagcaattagccccagtgattaatttcagaggattctggttccactgcctgggcacggtgatggtgcagagattcttcaagccatttgtaagcagtccatcttagaatgatttgggccccacatttgggattgattttgtttccttctcttcaaggtttgtatctttctttcatatgagtacatggatagcacgggaaaaggaccagcaatgagaagggtgtggagttcagatggctgctcgagtctccatgcacattccagattgtgttctgatgtgcagacatcaaaagagcgaggccaacgcttcagatcccagcatggttcagatgtgtggcccgtggagcagtgtggattcctgtcagatgctgagtctcagcaaaatccacatttgaaaagcaaaagcaggagccggagaatattccaaatattacttagatttcagagtgacagattgcagtgtgtgatcttcccctaatttttctttttatctccatgtctcccctgtaccaggccttaagagctcagaaaccctgaaatgctgtcaatcggctgcggggaagagactgtgcagccagtagtgcttgactgtgcactctttggtgtcaaatcaaatggggttggtcgctaacaaaaattccttatcagggtgacatgtctttatattcaagcagtagaagtcacacatgtgactatgttgaatttttttttatggagacactgaataataaatagcatgaggttgaatttaacttacccacagccaatcctttgaaatgacagtgcatggtaggactatttagaaatggacatttacataactatttgatcaattgcttagttcttcctcttacttatgcaaatgggtgggttttcctatggtgtgtggtcatgtacagagccttacagttgagaaatgcatcttgcatgatagaattgaaggaaccacacacacctgcttatcatactgctcatgaattccttctatagcttactgaggactcatctttcagcctctgcttgaatatttcttggacaaaatgttgttccttcataaggcagccctttacttttttgctgttgttgacggcttcagcagttaatggagttctttattcttacatttccaatcaccggatataattcagccttctgaagccccagttttcattctttttcatgttgtaacatatcccttaaggtttctttatttccaagtaaaaatcctggattttttccatggtccttttgtaacactttgatatcctccaagctcagtcatatttggtcacaatgcgatgctctcccaatcatgactagtggcttgaggtagagccctccttggcaaggtccagatcgctacaggtagacactaaagttttaagacctctccatatctgtgagctgaaagctccctgctgtttccactggagctcgattgtgtttttattgtgttcaggctgtgagttagtgggtatatcctacattcaggtcattgtcagaggaggcataattggcagtttagaacgtgatcacctaagcatgtcaggtgggttactgttttgtgttcctacattgcccttgggatctgatgtagagccctggaggaaggcaaatatttcccagcacgacccacaagagggaaacaggacactcatatttactgagccctcattttgtgctatgtgccatatcatctgactctcaccctaacccttctagcgagaggtttttatgtccactttacaaatgagatccagagaggataagtgacttgtccagggtcaagtggctaataagcagcattgccacaatttaaatatttatctgtggataactgaagtccatgcttttcctacaaccccatactgaccaaacatgtgttgtataataaacatttcttagacctctataaattgtgtgggggttaccaaaaggaaagatgagacaccatccccaactcaaagatctttgactttctgtctgggtgcagtagctatacctgtaatcccagcactttgggaggccaaggtgagaggatcgcttgaggccaggagtttgagactagcctgggcaacacatagaagacctcatctctgcaaagaaaacaaattagccaggcatggtggtgcatctctgtagccctagctgcatgggaggctgaggtgggaggatctcctgagcccaggagtttgaggctgcattgagctgtgatcacagcactgcactccagcctgagcaacagagcaagaccctgtctctaaaaaataaaatagttgaatttctaacggagggttaagaccagcaacaatatgtcattaatagagtgatggataagtaaatatggctattatattttgtgcgtgtggttaaggtaattagttgaggtaatttgaaaacctatgcctagacttagcttcataatcaatattttctaaagggcctagagctaacctaagaatcagtatttttttaacaggcttatatacataaaatgtggccaaattggcagtaaaagatttcactgatggcccagaaggtagatgcagttacattcctccaaagtcattaggggaaggtataatagacattcatctttgctttttttaaaaaaacacatacatatatatgtattttaaagcactgggagggaaatgcaagtttgaccacttttcagataagagaaaaatgccttccaaatttctttgggttaaaaggtggaaggagaaattggaaagcacttgcattttcaagtaaatttcctccatgaaatcatgggtatatcatttactccatcccagcctccaggcaccaccatgccaagaacgacctaagaaagttgtcatctatctcagaagaaaagttaattctgttatatttcttagctgccttgtcccctgttaatggcaattgttggaagttcaacttggtgtctgatgtcaattctacttgctgctgcttgatgtctaatgtaaattctgcttgtgctatgttctagatggagatttctttgaaaatattgctcaacgcttgaaaatagtcctaggcttttaaagacccatgattgtgcttcctcagtcttctcagctctccctaaaattactctgagggagaaaatatataattctattaattattattgtagttattgcacctctcctcttccctttgtaaggctaaaagaaacggaactaggccgtgtgtggtggctcacgcctgtaatcccagcactttgggaagccgaggtgggtggatcacctgaagccaggagttcaagaccagcctggccaacatggtgaaaccctgtatctactaaaaacaaaaaaaaatttagccgggtgtggtggcgggcgcctgttatcccagctactcaggaggctgaggcagaagaatcgcttcaactgaggaggtggaggttgcagtgagctgagatcgtgccactgcactccagcctgggcgacagagcaagactctgtctcaaaaaaagaaagaaagaaagaaacagaattgccagagaaggcaaaacaagactgcactgtgtcctagcttgtgtgtggcatatttctcatggtacactagtgccagctcagctcaaatgctgctcagccaagtgtcttgtggaaagttttgcccagggaatggaatactgtggtcctgacaaagaggaacccagctgtctgttttctttccttttcttttcttctcttttcttttgctttcctttccttttcttctctttctttcttttctcttcttctcctttcccctttcccctttcctctttcccctttcccctttcctttcccttcctttccattccgttccatttcttttctttccctttccctttccatttccatttccattttcctttcctttcctttctttcttctttctttttcttttttctttccttttctcttttctttcctttccttttcttttctcttttcttctcttctcttttctttctttcttccttctttccttccttccttccttccttcctttctgtctcccctcccttccctttctttcctttccttccttcttttctttcttggctggctggctttctgtctgtcttttctttcttccttgcttgcttgctttcttgccttcttgtctttctgtcttgcttgtctttctttcctcctttccttctttcctttctttcctttcctttccttctctttctttcttttcttttcttcccctttcccctttcctctttcctttccgttccgttccttttctttccctttccctttccatttccattttcctttcctttccttttctttcttctttctttttctttttcctttccttttctctttcctttcctttccttttcttttctcttttcttctcttctcttctttctttttttctctttctttctttctttctttcttcctttctttctgtctcccttcccttcccttcccttcccttcccttcccttcccttcccttccctttctttcctttccttccttcttttctttcttggctggctggctttctgtctgtcttttctttcttgcttgctttcttgccttcttatctttctgtctttctcatctttctttcctcctttccttctttcctttctttccttccctttccttcccttcccttcctttccctgcctttctcccttcctcttttcctcccttcactctctgttacccaggctggattgcaatggcacaatctcggctgactgcaacctctaccttctaaactaaagacatcgtccaaccttagcctccagagtagctggcactacaggtgtatgccatcagccagggttttgccatgtttcccaggctggtcttgaactcctgggctcaagcgatctgcccactttggcttcctaaatgctgggattataggcgtgagccactgcacctgacccccagctgtttcttacaggctccctgctctagagcaccagctggcttgtgttgagtgcttatggtgggcactgtgctaagggatctccaggcctgatcccagtttgtctccacaaatgtcctttgaggtcagtactaccactgcgttccttttagaaaagtgaagtctgaaggatagagaggaccagcaccttccccacagtcacacagccagtaagtagaggagcttgaatttgaggtgacataatacatctaacaaggaagaaggcaacctttctctgtataaatatttgtgattaacaggtgcagatcttctagctactgcaagctatgcttgcacagtagggcctaagatagctgcatatatcaccaataggtgagaaaacaaaatgcttcactcatttttgcatgggtagaaaatgactacctggttggacctaacctgagcatgtctctgttggagacactgtggaaatgtgtttacatctcagactaggcacttggcttctcccacatgctagacttcacctatttaaggaggcacctgaaggaagaatctccctggacttcacacttcctttgggcttccattcacacttccattcaatcattcattcattgtcaaatccttattaagcacccacagcaaggcacgtgctgagcatggaatatggttatggtcatagacatggatgctgcccttatgaagctcatggttggtcagagaattaaactagtcttaaccctcatctttctaggggaagatcctgaggctcggcggctgcggacagtgaagaacatcgctgatctgcggcagaatttggaggaaaccatgtccagtttaaggggaactcaggttacacacaggtatctgcagtgtgaattactttactgaactacctggtatcctaattttctcctgtgtttgttcatagcagtagcaaagcgatttggttataatggatcatagcctcgctttccaaatgtgccggaattcacaaagaatgccatatgacatgcagaagagagttataggaaataaaaaattagtatagacagatttttcccaaaagcagaaggttgctaaatccattcaacaaaggatactgtagaccagctctatttaaatttcactttacttgcattttctataactgtctggtgctgtggaaatgagcaggtgaactatatttgacctgtgtgataaactgaatagcttgaattcctacccaatcttctgatatgcagcactctgtaatattgttagtcatgcacgtacataaaacatgtaaggaaatatttataaaaacttatgatcatgttttaactctgatttagttggatgaaatctagtattacattggaaacatcaggtgctttcattgttgaacaagaagttgaagaggatgcaaccctgggatgtcttttgtgatttgggcaggaggaggttttatagttgtagaaatcaaggaaagttcttgttgtccccactgagctcccagggagtctcctttgcttctccaatttcagtttctttgataagtggctatggcaaggaaaccacagggcttccccactgtcagcagttttggaagattggggttaaccactgtgggttccatctccaataggaccgaggcccaaaacaaggggtccaatctgagaaaaataaggccacttccaagatcagaggaaaacaaaaacagcttaagggaccaaattggctcttccagaggagagtaaactcgggggtttgggggtggtaccctcttaaacctttaggtatctgaatgaaggggagtcagatattggatcttgtgactctaccattaggtgtgaaacatccctttttccaccatcgtcactgacactgacttaatgttggcatagcagtttgacggtgggatggtaattatgacaggagggaagacttcagtggtttcttctgcagggaagaatctcattctctgctcagtgaggaaattccagttttcctgtgaaggtgcacacgatagtcttgactgggctgcaagaaactgcagcgctgtgaaaacagtggaagacagactctgccaagagattgagctcatccttgggcagattctagtccatgtaacttgattgaagagggaactcaagcccaggcatttaccaatctttccaggctttttggatgaaatatgagaaaagcaaaagtctgggggaagtgaactttagagggttagaaaattagaactgtgtccactgctcagttgggagggagctgaggatgtaaaatgtggtattaggaactcccggtgggtggagaatcccacccttaggaaaagaaggctgtgatgcaacatcctagaatgaatgggcaagcaggaaccttcatgccccatcctaatcagttcagcattttctagtattttctttcccagattggaaagaaaattcttatttttttttttgccgggggggatggagtctcactctctgtcggcaggctggagtgcagtgatgcaatctcagctcactgcaacctcagcctcctgggttcaagcgattctcctgcctcagcttcccgagtagctgggactataggcacatgccactatgcccagctaatttttgtatttttagtagagatggggtttcaccatgttggccaggatggtcttgatttcttgacttcatgatccgccctcctcagcctcccaaagtgctaggattacaggcactgcatctggcctggaaagtgagccactgcatctggcctggaaagaaaattctagtagttgaggtcatttaattaaagtaattcgtttcttgtaccatgttttagcagggaaagtctccggtaggcttttcagaatgttatgtagatgtgtagctttcctttctcattttgagcagaggaagcacatcaggtggtacatgggggctggctgttttatcctattttatatatgaggattatttcataattctaaataattaaagaacatataaactgtgaaggatactaggtacctttgagtctaatcaggttggttttgtttctagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcgggtaagtacccggggccgccctttctcccagagagaaagagggcttggcacctggcttctcttttgtagggctctatttgattcttctggaggaggtcaaactgcccacctgagtttctgctgtccatatcaaaggctgtgtgacatggagggaaacgctgctcggctgtgagtctgaaggcctgggtagtccaggcttggccagtaaatcacaacagagtaatacctgaaaacaaaccatgtcgcatcagtcccttaaaccaaaccttgcactgaggatggactacttgcaggttagacggcctccccgggcctatgagatctggcctgtacctgcctcttagatctcatcttcctctctcctacctatttccctgctgcagctgtcccttccaatcttcaatcttgtcaagctctttccggcctcacagccttgcactctgtttctcagcctggattctgcttcccagatctttgcatggtaggtccttcttgctgctcagctgacacctccttggaggggccctccttgaccatgcaatttgaagtaggtgtgtgtcctgcctcctgccctacgcatctccaccactctgtggcaggctcctttggaagattatcactattcgaaattagcctgattatgtgtatatcctctgttgcctcccggccccctcctacttgcagcagtaagtaccataaagcaaggacttgtcttgcgcgttcactgcagaatccccagtgtgttgtgtataataggagctcataaatattgctaaatcaatgaacacgtgaatcagtgaatgaatgaacaaatccagcctccctgtttctctgtgtgctcatatatgaagtgaaggggagtgatgagatgatgtctaaggaacctttcaggtggagcctgccatgactgtatagcacgaggcctggctggtaacttgttcatgctcccctctcagatcaccctgcagacttaaggtgcagtgagttatttcacttgcctgggacttcttccttcatctgttaacatgacttgcccagaagttctccaagatcttttccaccttgaatgttctagctgttaaagttacagataagaaaaagcagaaatactaattgtgccactcatttccatgaaaataatgatcaagaacccaatgggtgagccagtatttttataatttaaataatagctaactctcctatatgccaaacacagtgctaggtgctttacttttatactctcttgttctatctccatagcaatcctttgaggtagatgatatcatagtccccattttagagatgaggaaggtgaagtccaggaaggttaaataacttgcccaagggcttgcagctattagggacagagcgtaatagtgtaccatcttgccaacgttttattgctgtattgaaatactacaactactagagtttatttcaaaatgaatttgatttttctctgttctacctctgtgactagaagtgttcttttatttcattaaaagctgaggcatagaggtgctttggttttcagcctgttacttttagaactatcttgggtagtgaaatctttgaaaacagaatccaccaaaccttttgcaggggcaaaaggaaaatttcccctttaccctctgaaggttcactggaaaatcagctcacaaaaggcagattcattggagaaaggacatacaaatttacttaatgtatatacacagaagccttcagaatgaatacccaaagatataggggagattgtccaattttatgcttaggttctacaaagtacgggcagctgtgtagaaatatgattgggcaaaaaaggtatgatctaatgctagcagatggagtggggaaaccaagcaaggttcttcttggcccttctgagaagcattcctgccttctgcgtatggggcagagccctctctgtaatggaggtttctacaatcaaacaaggtgggtcagataatttccttatgcccaggcttcacacagaaaggaagagggaaaattagaataatgtttggaggttttatgactggctttggggaaaaagggttctgatttctatggcctacctaggggcagagggattctagtttctatggctggcctcaggggaaataggattgagagaccagagggcagaaaaaggtcagagagaaactttcacttctgaggcctttattttgtagtgttttctgagctgcccaacaccttacagtacaacaaatttctgctgcctggaatggctggcgcaattaatggagtgagaaattaaatgacctggtcaacttagagcatccttttttttctagttttccataaacatgaaaaacaatagcatacacctattacaactgaatttcacataatgtaatctttgtattattgtttagaagacttttggtatctagcatggactcagatttattattatcaattcccattttcatatactaccgaacaaattgtggcttgttttgaggtttttgtatcctgtaatagttgattttattgtcgaaccagtctttcaattctaaaaagatggccagtgaattcattttgatgtagtgttgattatgtccacaaggtggagacattgaaacactctaacctgaatcttagtgatagccgactgagaaactcctggtttctttaaccatccaaaccagagcctttacctttgcttaaaagcaccgatgtttacatttcagttccagctttgccaagtttacgttttagcatgtgtgatagcacttagagcaagtgtagataaaaagttcagaaacgtaagcaaagcacccaattactgaaactggagaactttggtctggtttctcttcctgttccttttaatgtagaaatgtaccctcagcatgaggagaggtagcccagatggaacctaatgctccttctagttgtagcattctagaacacttgttaagcatgtatccactctgtggaaatgcatgtgaatttctgctttgaggccaagttaccagtttgtgtttacacgcagagttcagagcaagacacttaatgtcttttctactcatcatattcttcctataaactggcaaggttgtaaatattgaaaggctggttattctgtgcttcagaatgtgctgaataaggcattgttgaggcaattgatgtagtgaaagggaaatagactgggatatcatattgggcagaccagggcttaaaccctccccaacctcttgccagctctgtgacgttaggcatgtcatttgacttccctgagctttgaagtgctacaattaatatggtttttaaaccttcagctggatttctgtttgcagttgtatctgataaagaccaaaatcccagtcggggtctagatgccttatctccctcaaacatccaggcgcttggaaacaatgaaatgattaaagcttttgtccagatgtttatttggcttagtagaaatgtagccttgatgtatgagtaatatatcaatctgtacagaggctctttgaggaaagttcttgtaaaagtttatagtaagtttatttagaaaatctgatatggaagtaaattctggtttctaaaaacctaagacctctgtttttaaagtgatgctgtacttcggcttggcataacagctattttttgatgcctctagttcattttctgtactggtgtgtgcatgtgcacctgtgtgtatccttcaattctccctatggtagggctgaaattactttattaccatattaccatgtagtttagctaagaattaagggcaaatgcctcttacactttgtgtgtgtgtgtgttcttatattgtgcctggtatataccaggcatgtctaagtactttacaggttgttatctgatctcactcatcccttttattggattgataaattgggcattggctgtagtggggaggaaattaaaataacagatgaaatttctcttactaggttttgatctgtgaagtcaatcttctactcatattctaaaaattcaaagtgccatatggtacagaataaaattaaaggggcagactccacgtccatatgtttgaaatgattttttttttcttttcaaaggaggcactgagttgtgtaatgttccaaagtataagtagatatccctttatggacaaaaaaatgaccctttaaatataacatcagaagtttctccctctcagaacctttgatggcttcccattgcctgtgggaacagatctgaatgccttaactgactgtggaggctcttcatggcctttgcctcatctgccttcgctgacttgcccccggccacatttcccttcacacactccagacttcccactgctctaggctacctgccaccaccaaaagctggttcctgcatttgcaaagccctgcctctggttcctgcatttgcaaagccctccctcctgggacatgctgctttcttcctggaattcctttcccctcatgcccatctgactaatcctgaagaaaatgtctcccctgtgatgtcctctgggattcccccagtcacagttagctcagtctcacgtgtttctggtagtcttggttcacacctacccttatatataagcgtttcactttgcatgggaagtgtctgaaagccactggatggtactgaggaaagagtatgttcttaaaaggcagacagacttgagatttaatcctggctctgccaagtgaactggaacaagttcttaacctttgaatattagagatagagcttgaaaagaacaggcaagaatctgagatgcacaagaaatgtgcacgcgcgcgcgtgtgtgtgtgtgtgtgtgtgtgtctttctccactaaacttggagttcctagcaggcagacagcactcattatttttctaaacccagagactgggacttagcaggtatttaatattttgagaatggtctattcttgatgcctactctggcaggaccttatgcttatataactcgctaccacacgctatgaagctcaatggttctatttacagaacacttggagaaagccagcttagcctgtggtgtccatctagtggttgatagaggctgtggtctcaattccttttcactgtgagtcattgtgttggtttaaagctcctggctggtgatatttagggctaaggatgttggcttttgagaatgaggctgatcaatagcctagtgtagagagaaaacaggatgtaagcatttggtcttccacagtggctttttaggggctgctgtcttccctccttggtggcaggaattactccatcaacaaatatgggcacagatgcctgcggggagactccgttcttcagaaattgaggaactcattcatgctgaattaattaaagtcatccctcagtatccatgagggattggtttcaggacccccagaaaataccaaaatctgtggatgctcaagtttttcatgtaaaattgcatagtatttgcatataacctatgtagatcctcctatatactttaaatcatctctagattacctataatatctaatacaatgtaaatgctatatggatagttgttatactttatttttgtttgtattatttgttcataagagggtgcttcgtgctctcatgcatcatttgcatgtataataccttgtatcttttcctttattgcctgtcaggtcatctcctctctgattccatccaagcagaggtagtgacctttctgtatgcttccttgttacttgctgtatctgtattagcactggtagcactacatcagaattggtttattagtgtttgtatgtatgtatgtgagtatatgtgtgtgtgtatatgcatgtgtgtgtgtgtatgtatgtgtatatatatgtgtatatatgtgtgtgtgtgtatatacatatatatatacatatatacatatatatatacatatacacacatatatatatatatgggataggaaagacaaaacccaaacctgttgtaagttctaaaggttagggtcaaatctgtcttgaatgctcctgtatcttcattggctggcactgtgcctgcctgttgcatagtaagcagtcaataaatatttgttggctgggcatggtgactcacatctgcaatcccagcactttgggaggctgagatggggggatcatttgagcctaggagttcaagaccagcctatgcaatatagtgagacctgttgcaacaaataatttaaaagctgttcatggtggcatgttcctgtggtcccagctgaggtggaagtatcacttgagtccaggaggttgaggctgcagcgagctgtgattacaccattgcactccaacctgggtgacagagcaagaccttgtctgagaaaaaaaaaatgtcaaatgaatgctacaactaactttaaaaatggcaaggccaaccatattccgctaaatgaatttgtgcctatgattgtagcaccattgagtttgaggacgtagccacatgtctttcttcttctgggccctgtcagtttagactgcctctaaccctgtgagcttgacattgtcaatacaagaaaaagagagaactaggggcatttgccatgtggactgatggaagatagacatgcccctgttcatctcttccttctttcactgaacattatgggacaaatgtgtgaggtatttctcaccaagtcagcatagaacatagcagacagtaccctgaatcaaagggggtagattaatagcatgaaaggctctttcttatctggtgaatatgtccagaccagacctggagtgaccttgataggctgttgtttctggcagactgataggagagaaagccagagtgctccttacagcctaacgcaccctggagccaagataaatgaatttaggagaggctgtcctgaaaggcactgatttatggcaggttccagcagggtgtggcaggcatctcgagatttggaaaggatagattctcgtttctctaggccgatcccactgaaacgatcttggcttttggcgctcttggaacgcttgggaagttcaggttgccagccagccagtgggctggtctcagtgggattaggaagactgagctgtcaaggaaaggtaaagactcagctatgtggacagacccatctgtagggcttggagccaatgaatggaaagtctctcttcccaacactcagacactaaatatgtgggttgctttccccacacaaccaattctcctacaccagctgaacatcctataattcaattcaattcggacacaatctacctagagttagcctagacgccacaggttaagggctcagttccacaagattaccacacccccgacacacatacacacacacacacacacacacacacacacgctctctctctctctctctatctctccagatgccaatcacaagtcataggtcccaaggttacccacacttctgtccaacttggctgcaaatcaggagttcccatgacctcccttacattcagaaatttgctagaatggctcagagaactcaggggaacacttatttactgtggctggtgtgttataaagcatatggtaaaggatacagttgaacagccagatgaagaggtgcatagtgcacggtgtgggggcggtgcagagcttccatgccctctccatgagtgccaccatcccagcaacactgtgtgtccaccaccctggaagctctctgagtcccatagttgaatgtttttttggagactctattatgtaggcatgactagttaaatcattggccatcagcaattaagtccatctccatccccgccttactgtctccttactgtcttggaggtcagagggcaggaatgaaagttccaatgctctaatcccatggttggtttgtctcgcaaccagctcctatcctccaagagtcacctcagtagcataagcccaggtatgtttgaaaggggtttgctatgaataacaaaagatgctcctcttacccctatcaagaaattccaaagacttaggagctctgtgccaggcactgggagcagagaccaaatatgcatttctcattatgtcacagcaagtcacttgcccctaatgcactgccatcctcttaaaacagacagacttaaaagatgcaatgaggctccaagatgaaggaacaggcccagagtagcccaataggttggtgatggggctgggccagatcctgtctagggttctttttgtgcctctctgcttccctcagtgtctacttgctgacagctcttaatagtgtatgaattcacagaaatcataaatacttttccctgtctgatattttccttggtgttaaatatcccaggcaagtacaatggtctcttttcctaagcagctctctaggtagagtgagcaagcgcagagtcatgcagagggcaagattaatttccccaagtgctgcagaacaaatgacagctttccctgcatggttgtgatgttgtctgacatgggtggtttggcagatggatggctctggctactaatatcagtcatccctgatggctggggcagcataaactgaacacctcttctccctccacggtggacccacttgatgtactgagtgcaggaaacctactagcccttatcggcgtctgggtaggcagtctcatcagaggagaaagaatagctgagctgctagcccactggaggaggagaaattctccagcactcccatgcgcactctgtccactgctggtgacgacagacttagcaggctgagacctggattaaaaagagatttactgggggacagccccatggagaaatgaagtgtggtccagctttgacgtgggcagcccagactgccacagatgtctaatggcaaatgctggcttagtaatttatggggaagagagagagaaaaaaaaataaatgggtgtcttgtcttctcaggaaactagggttgggcctcgatttcttgggaatttcctaactagctttgaggcttgaatcccttcctgcctccctcccacccctgcatcctgtgggaaggaaaaagaagacgggaacaaaagtgggtgctttgggagaaggaagtctcaggcccttgttgagaggcctccaaatgggctgttccctgcctgccacccacccttacagatgtcctcctcctcccatagctttccaaagcacagggtcttctggccttggacactggaatcctttcctttggcctaccttctgggtaggctccaggcaaaaggcagtaaaatcccgtgtaaaaagtgtttattgagtttgttatatgttaaagactatgctaaaagcactgagaccaagggaaatgagtaagaccaggttgccaagatcctaacgctgtgaaggaaagatcatgcaacagggcactgtgtaggtcagcataagagtggtgagtgaaggaggccagtgaggaagtgatggcttgtgttgggacacaaacacccttaccataaggtgagggtcggtgggaaaagtgtgggctgtggagtttgacctgcagtccaggctggttccactactcttagctgtgtgtcctttagtaacctatttaatttcactgtgcccatctcataggtttgatgtgaggtttcagtgagatcatggtgtgtactctcagcccagtgcctggcatgcatgctttaagcactcagcagggttcgctaccatattgtccaccactgtcactaccagcagcagcggtggcaccttgaggacatgtgagctgggcctcacaggataaacaagggcccaggcagaccaatagcctaaggacatacaggcattgtcatgttattatgaggttggtgcttgggtgggttgcagattcaagatggaggttgggaggcagtgggctcaggttagaagctattccagagtccacgcagcagagccacagggctgggtaaggccagggccaggggaacagatgcacaatgagtttaaagacactttttacattaaactcagcctgatgtgggggccagttacacaggggacacaaaggagacagagaagataaggatggctccccagctccagcctgtgttgtaactgctgggaaatagctgatgtctgtcctcagcatcctttgtcatttcctagctttccctcttgcatgttagcacccaccctgtgctcccagattgtctcaggcctctcaggccacccccagaccaaggtgggttgaatgtttaaggagagtgtagaatatgattccaggagccttaggaaaacccagtcccacagcctgccaactcttgtccccggaggaactcagggcgcagaggggaagaacaccctgcgtgtccatagttcattgcaacccaaggcagatggtggtgaatgttaacatgaagaggcaaaatgtgggggctccaaagtggatctgaaactagagcaggtcctgtggggaccttgtaagttctcactttcacattctgggaagcccactgtgctcatctgcaaatgagaataataatgcctggagttatggtgacaattgaatgaggtgacacaggcaaagtgctagcccagttcctggggcattgcagacctcaccaaactgtcctcataatgagggtgtttcctagattcaatctgatataaccaaattcagcgcatcgtgcaggataaaagtacttaacatatttcatgctcttccccgcatgactcctccccaagccccaaagggtaagaagctagtgagccctctccttagacataagaccataactgatgttcatgtgggaagcatgaacacgataccctccagccgacagctaccgtgctgggcgagagaagcccgctgtgactaatcatgcttagcaaggtgctccttcttccccccccaccatctggactgtctgctgtcttgttggaacggacctcctgcccttccggggctcttcactggcaagcagcatcaacaaaacacagccagcatttgggtgttactgagactggcccagatgtttaagggaaattccaccttaagtccattaatcaacatgaccgagactctgcatgttagttgaatcaagttggcaagtatttagtaagttctagtcagttccaggcccctgactgtgccctggggcttgatggacaagaggaggagtcggttatttgttctcaaagctggaccgtttgatactgtactttttgtgccaacttttgatcattcaaggttcttaccaggggcccatgagctcacacttagtgaagtgtgcttacatgtacaggaaaaacatattccatcctactctggagctccgggtggcttatgggggctgatatgtgtggcatcccttctgtgtgctaggcatcttatctaactcccacactctggctttatactgtttttattaataaagaaaatgaagaccctagagggtaattgttacttaattgtcttaagcccatggaagagttgaaaaagatggcctaccattttattgtcactttccctttgtatcctgggattccagtgtgactttggtgctcttgttgctttgctatagttgatgctgtcctgcatcctttagggccacccttttttaaaattttatttatttatttatttatttatttatttatttattttttgagacagaatcttgctccgttgcccaggctggagggcagtggcacaatctcagctcactgcaacctctgcctcccgcattcaagtgattatcctgcctcagcctcccgagcagctgggattagaggcacatgccaccatgcccagttaatttttgtatccttagtagatggggtttcaccatgttggtcaggctggtctcaaactcctgacctcaagtgatgcacctgccttgggcctcccaaagtgctgggattacaggtgtgaaccactatgtccagcccagggccaccctctttgcctggagagtagtggtctgcaggcatcttctttctctactcagtgttatgcaaatggacctggaagacagagacccgagggctcacagacagtccctgagcccccctgtttttcctgctaagcctttgcatagttctcatctagaaaaccaaatccatatttcttttctttttttaatttaaaatttttttctctttttatatagtgatggggtatcactaggttgcccaggctggtcttgaactcctgggctcaagcagtcctcccaccttgacctcccaaaatgctgggattataggtgtgagtcactgcacccggcccacgtttatttttatcttaagcatgtagatcactcaagttgaaaatacccttcccagtatttttcaagggccagcagctacagagtggctcaacagatttatgatgggaaggttggagaataccaagttcgagttgaggtgaatatgaaaagaaacatttggacaaggttgggagtattttggccctgagacagtcggcccatgttgaaagactcaaaacagaaggctatgtgtgcctgtgctcagatcaagataagaagcttaagttttgttgggacctcatgaacctctcatcaagctgttctggaagaaatgtacaatggaaatggaagaaactttagagatagaggcagaagacctgacttcacatttcttgattggcagctgtgaccatagggaaatttcttcctttcctgagcctcccatgtgttaaactgtggcgcacctctcaggtgtgtgaggaggagtagaggagatggtgtttgtaaagtgtttggcacaggtagcatggtggctcctttagccctattggagttactacatctgcttgcctttttagtcttttattttatttaggacatttacgaagatgatgtcaggcacaacatcttattcttgagcacagtgaccaaatagctcctggctggatcagagttggtctgtgcattagtcaaggttctccagagaaacgaaaccaatagggtgtgtgtaggtttgtgtgggtatgggtgtatgcatgtgtagaggaattggtcatgtcattgagcaagtccaaaatcttcagatgccctcgttgcaggccaagaggggattctacctttagactgcctttagactcgagctgcaacatcaactcctccctgggtctctcagcctattggcctgcctactggctgagagatccagagtagagtcagtgtggcagctcaaatctaaaggcagtcttgaggtagaatcccctcttgctcagaggacatcagtctttcaaagccttcaactgattggatgagacccacctacattatggaggatgatctgctttactcagagtctactgatttaaccgtcagtctcatctaaaatattcctttgcaacaatatctggactctagtgtttgaccaaatatctgggtattgtggcccagccaagttgacacataaaatcagccatcccagcctgtaagcaggccttgccatatgatcagtgggagtgaatcatgtaagggaggaggcaactcacctgtggcccagggtcaacacatcagctttaataaacatctgcaagggctcaaagctaacgcaccctgcctgggatgtgaccacagatcaagactctatgcctgccttggaagaatcattgcatcccttccttcgtcccctgggtcctggtaagaaatctccctgagaaatggaggttttgacctttcctcttaatcctgaaataactgcagagtgagacagacacactggcatggacacctccagagagctgatgatttttgagacccaaaaatgaaataagattctgagcctaaggagaggccccaagtttgtctccagagccttctacctataaatcaagcccacattcacttcttgatcttgggaacagtgggagacagggtctgtggttatctccactgcatcactggagtcttgtatccctttcccagagctttgtgcttgtaatcatccagtcatctgtttcgaaattagaaagctcacatacttgagcagtgaagtttaaagggtgaagtcaactcaagttgtcagaaacatgggacgaaataaatgtggtgttggctctatagagaagggggaaggccacagaggactcaacagcgcctgctaacccatgactttctgccagtcctgctgtggtggcactgtaattcatagtcgctaactgctttggagagtttattatgtgctaggcactgtgttgagctctttacatgctttttctcacttactctttccactagttatttgcaatagagactgtttctcgtcccagttttacaatcaagggggccaaagctctgagaggtgaagttacttggccgggccacacagacagtaactggtggaagcaagcattcagccaggctgattcaaagcccgggatcccaagcaccctataggatggcagtttactatagctagtccccacactctgaatatccgaatatatggaaggcaagaccaaaaaggaagagtgtgcaccttctgaacatcggaagccctggatactcccagtgccatttgaaggagctatgaagggacctgaaagtgccatttggaagggtaaggtacagaggagtgagttatgtaggaactgaaaaaaatagctggagaatgcttgtgcaaggaccatggaggctgtggcaggggcagaggcagatacttctctttgcctcgaaagcaatattatgtgtttaatttcaattaaatgtcacaggtctttactgtagcatgagaaacacttgtgtcaacattccccagtgcttatgcagaaagtgaatgggggcaaaactggttctctgcgtgctggaaatgaaaaccgatgaggtgctcagaggcaggaaagttcagatcaagagccaattctgcacagtgatttaccgaagcgccttaccgcgatgtggcttcctgttgttaaatctcatgaaagtgggcatttcagtcacctatggtttctagacatgatacccgaatttctctgaggaaattccactccctcagcccctcacccactgcaaacccaaacaaaacccacaattacaagctcagcgccaccctgagacctcagaattgtgcacggcaagttagagctttattaatcgagtgacttttgccttactctttgggagttgttaattaaaaccactcaaccattgagttgagagagagggagagagacagagattgaggacagctaacagactggattttctccctcctttgcaagctggtgtagctattttagaagctgacacggacgttacagttgactaaaccatgcaccagatttgtatgtgaggctccttgggaacagctttcatttaatgccctgtagccaggccctcagggtacaaagaacctgcctagcctctgaccaagtatatataacggttaataataatgaccattgtaataatattaacacgactagctaccgtttattgaacacttttaaatgccaggcactgtgctttatatacattatctcttttcatcctctttttttttttttttatgagacaggagcttaggagctctgttgtgcaggctggagtgcaatagcatgatcatagctcactgaaacctcgaattcctaggctcaagcagtcctcctgcctcagcctcttgagtagctaggactataggcatgtaccaccacacccagctaatttttttaaaacattttttgtagaaatggtgtcttgctatgttgtccaggctggtctcaaactcctagcctcaagtgatcctcctgtctcagcctcccaaaacgttgggattacaggcataagccaccacagctggcctcattctactttttttttttttttttttttttttttgagatggagtttcactcttgtttcccaggctggagtgcaatggcacgatctcggctcaccacaacctctgcctcccgggttcaagcaattctcctgcctcagcctcctgagtagctgggattacaggtgcgtgccaccacgcctggctaattttgcatttttagtagagatgaggcttctccatgttggtcaggctggtctggaactcctgacctcaggtgatccaccccactcagcctcccaaagtgctgggattacaggtgtgagccactggacccagcctcctattttaatctctatgttctaggaactcctcttcccattctcctgttgaggacacagggatttgggggggcggggccactggtaacttgccttaaggttgcagaggtggtgagctagggagctgggactcaaacttggacagcctgacttcagagcctgaattcaaccactcatttcaggactttcactgaagctgtgtacacatgtctaaaatgtaatcgctcttctttcccccaaacctgtttttcttctgtgtttccaccatccatttttttttcccacacccagaacccagaatcttagactcttccattctcttgttcatggaacgccagtcactgaatttgatggattccatttcttaagtatctcttactatggtttttctctcatcttgctgctaatatttctcacccagatgatgacaattcatcctttcactaattgcctttcttctgatcccaatgcccatccaacaaatccattccacacattggtgagagagatctttctagagcacaaatctgattatattctctgcttacattcctcagtggctcttcactgcctgctgagaaaactctgtgttttagttactgtttctgtacaacaaattactccataatgtagcttcttgaaactaccatttcattatgttcatggggtctctgcaccaggaattgggacaagatatagcagagatggcatatgtctggtctgccatgtgtggagcctctgcttggaaaacagcagggctggcattgacttgatagctgaaggctagagttattccagagtttgttcactcccacgtctcactcctgggctgggatgacttgaaggttaagatggctgcagcctctccacatggcgtggcttcctggggattggcaaacttcttacatggagctcagggctcaagggcaaagggtacagtgaacaatgcagaagctgcctcaccttttatcatctagccttggaaggcagagactgtcccttctgccatactgtattggtcaaagcagtcacgagccctccagattcgagaggaaggtgcatagatcccacctctcagtgggaggatggcaaggtcaccttgcatgtgggatccagagatgttgctgtggtcatctgtggcgaatacagttcacaacaatatatccccataccacccagtgtgatatacacggccctccctccatagtctcacattggagtgtctgctccatggagacacaagccttgtctttcttgtacattatgtatccccagtgcctagcacagagcatggtgcatcatgggccctccttttgcatttgagaagctaacaaatgatcaacttgcctagcctcatttcttcatttcctgccatctccttcatcccctcactgaccacccgtcctctccccaccccagctgccatcctgttcctgccactctgaaccacagacgttttccttgatacagacaccatgctcttgtaactgagcctttgcatgagtctgctctgtccataaactcctccccatcaattaccacccacctgccacaatccttcaagagtctactgcagctaggaagcctccgctgatgcacattgatggacattgatggtctccctcctctgagtttccaaacgcctggtaacagctcccagatggcttctcttatgttctttgggctagtttgtcccccaggccagaatatccttgaacagagggattgtgtctttttactctctcacgtttccaacttcttctaccagacctgttgtgtatgcttgggtaatatgagcggaatgaaaagagagagaaagggggtgatagtaggagcagtgctgctgctgctgctgctattaataatacaggtcgtgttcattaagtacttttcatgtggcaggtgcttttcaggcattatctcattgaattctcgtagaaatcctggaaggcctataacatgtgattgtccccatcttacagatgtggaaactgaggatgacagaagtcccttgtccaaggtcatactgctactaaagggtgcggccagtttcaggaagcttgagagccaagcctattctcttggtgctgccgcctgttgcactttaggctctgtagacccaaggattttcctacctttccttagagctctacaaagcctaaccttcaactggattcatagaataagaatatgggaagcaacagagtttctgctagctagacaatatcaagctctgtcttattctcggtgctaggttttaaggggttcagaataaggcagaggtttttttttaggaacaggtaacaaggtgcaggattcaaaacccaaaacataatagaaatgtttgtagaaagtacaaatattggcttggcatggaaagtacttagaaaagcagtaggttccaggggaccaaacttgaaccataggtggaagttagacaggttttttattgcctagacaccaaggtgaccattaatcagcataaggaaaaatgtgcccaaaagtagacctgttaaaactagaggcagttttgcaaggacatgagccctgtcactccctgttcctgggaatattcactcagaatctggaaaactctgtatcccagatattacagaaggggttcctgcatgaggtgaaaaggagacaaagaggtgatctttcaaaggtctttcagttttatgattcagggtatccaggtgcccagaggaatcattacagctggattatagactgagcagactgggtattgtattctggagataaggatctccttggaaagccacgtttccacaggtcctgccagcctgggggtgatagtagaggcaccaaagacatttcttctgaaaaatgtttaacccatgactccttctaataaatacaaaaattgtgcacacctccctgctgccccaggttctgatctggaagataaggaagtggactgtggctacagtccagataagagtatgaggaccgctggaaacacagtgtctgcacaccagctgagatgttcatgaactttactacctagagttcatatgatgaaaacaaatagggtgttgttgttgatgtagttttgtttgtttgtttgtttgttttgagatagagtttcactcttgttgcccaggctggagtgcagtggcgcaatctcggctcactgcaacctccgctcctgggttcaagctcctggattctccgcttcctgattcttctgcctcagcctcccaagtagctgggattacaggcacataccaccacactcaactaattttttgtatttttttagtagagacggggtttcaccatgttggccaggctggtctcgatctcctgacctcaggtgatccacccacctcggcctcccagaatgctgggattacaggcatgagccactgtgcccagccttaataataggtctttaaagtgtaaacatgttttactgttgaatgtgctctctcagtatgcagatcctagggaattctgctttgccttcaatcccatttgaattatgattttagcttatctgtctaccttcttgtggaagtggaagcgtttgaacaagttaaagagtgaaaaaagtcagataccccattatttggtctgtgtagcagtatcagtcactatgaccagctcctggtgcactgatagaaggtaatttgagtgtcctataggcaactgaccatagcttggctcctactctggaggtcattggcctgtgtttcggcgacttctcagcctgtctttccccccagagtgctccgactgctgctagggcacccctgccacaccctgttcccaaccgccttggcttctccttgtccgcaggctggctgggttgcctgggtgcttggctgcttggcttctgagtgtctcatgcccaggttacctcaagagctccagcagctgccttcctacagggagaaacgtgctcatccacacagtttgtgccacaccctgtccctcttgtgaacacacctgtggtactgtcctgacctatacatattgaaattctaaaagagaaacacagttcttttgcttttcaaactgtgctccccactatactgctttcacttttctaagaatcaaatacaatgggaaatttggccatggagaaatgaaactcgcttcagctcaagttcaggatgccttagggtgtggcagtaacattgttcccaatacagtggactctttgctggagccatgctgtcccttaaatgagacccggaaggcccacatcttcctggaagtcctttttggaccctttctgtatcattgtctactattgatagtatttgacttatctctaaagcagatgcaaggatgcatcttatttctctttgtgttctccagatgcttaatgcataaaatatacatacactattcctcccttttccataggagatatattccaagaccctcggtggatgcctgaaactgcagactgtgcttaactctatataaactatggggtttttttcctatgcatacatacctgtgataaagtttaatttataaattagacacagtaagaaattaacaacagttggctgggcgcagtggctcacacctgtaatcccagcactttgggaggctgaggcgggcggataatgaggtcaggagatcgagaccattgtggttaacatggtgaaaccccatctctactaaaaatacaaaaacaaaattagccaggcgtggtggcaggtgcctgtagtcccagctactcaggaggctgaggcaggagaatggcgtgaacccgggaggcggagcttgcagtgagccgagatagcaccactgcactccagccttggtgacagagcaagactctgtctcaaaaaaaaaaagaaaaaaagaaaaaagaaattaacaacagtaactaacaataaaatataactattgttacaatatgctctaataaaagttatgtgaatgtggtctctctctctctcaaaatatcttattgtaccatactcacccaatgtgagaccacagttgactgtggatgactaaaaccatggaaggtgaaaccacagacaagggaggactacagtgaaagcagttttttgtttttattgagacagagtcttgctctgttgcccagggtggagtgcagtggcatgatctcagctcactgcaacctccacctcctgggttcaagtggttctcctgtctcacgctcccaaatagctgggattacaggcatgcgccaccatgcctggctaatttttgtatttgtagtagatatggggtttcaccatgttggccaggctggtcttgaactcctggcctcaagggatccatttgcctcagcctcccaaagtgctgagattacaggcactgcacccagtccaacaatttaattgttgattgttatttattctttcttcagtataccaagaaacacttggtaggtacctatctcgagagttgaaggcacagttatagggactggggattttgaagcaaaagtattggttctgaaataataataacagagctacctttattgaacttgttgggtgaaggctggagcacaagaagaaagacaagccaacagttataataaatgtgaaataagggagccaggcttcaattttatcataaaagacagaaaaaggatttattgaacacacaaatacatttaaatgaaaaaaaccttagtgactactttctacttgtattttcttggacaaatcactccaattctctgagtcttcattttgcatctgaaaaatcattaaaccaagtaatctttgaaatccccccagatctaatgttctgtagttccatgaaactgcctatcatgaatgtttttctcaatgctctgttgcacttaaaatgaggttttagagttcacaccttctcagtgtggtgtcctcaagtgggaggtgggggagatgatctaaaagacatcctgtatttcgacattaatatgctagatgaggcagaccatcatggtgtgggaacactgcatgcccaggtgaagataagcacaagtgttttagtcattgagagcacatcatctggttttggggagtttgtgtcatgtctggccccacaggcacgtttttgagtaggacacacttttgccaaccttagtagaaaagggcatttttccattgctcactatgcgagggacgggggttatgtggtatgtgccaagctgaagaggttagagtgattgttcttttcttgtggcctgtggtttgcatagggtgccttttcactgtgggattttatcttaagactttctaccatggcctgttttctttttagggggcaaggggatggagagatgggtttgggacctattttgcagggtataaaaaagcctttttacaccccaaagagagagctgtgagatttccctttcctggctcagggcatgggtgggccccccggtaacaccccagccacacagccttgtttccccccatgtgaatgtatcatatgcaacttttgtggatgtacaacacacttttggatagttcctgttaatatggaaatctggtaccttaattagttcaaaatctgaactctccaggaagacaatgactgatttccatcctcacatattttaactcaatgtttttcaaacttttttctgttttgagacagtcttgctctgtcacccaggctggagtgcagtggcacgatcttggctcatgcaacctccgtctactgggttcaagcaattctcctgcctcagcttcccaagtagctgggattacaggcacgtgccactatgtccagctaatttttgtatttttagtagagacggggtttcaccatgttggctaggctggttttgaactcctgacctcaggtgatccacccacgttggcctcccaaagtgctgggattacaggcataagccactgtgcctggcccaaacttttttctttttagatgtcatgccccatcctgaaagatctcacaccctgacttgggggtgaggaggtgcagagctggagggtaaaattagatgtggcttttcagaatcactgtatctttaatagctccacaacaactcaaattttgtcaaactttagctacagaatgcattatcaaaaacattgggccttgaacatacttttcaaattcctgctccctccctggagataggatcattcctacagacaaccagtgttctcagctgcctgtgtacagtttctgaaggtgacatctggacgagtgaccagggccagcatttcatgttgtcagctgtcatgtctgctgttcttgtggattcaatggctgctaatttgagcatccgatagtcacctagttttgcttaatcctctacccttgaaggccaaaggtctatatatctgtttccttggtattggtggtttattttttgaatcccatttagaataagtgcccagaataatcactgtcttgatgaaaatatcacctggtagaaacttagcatagaaaaccatacaccgagttcactttacatgttgggtcctttgtgtttgtacatgcgtgtctgtgtgaactacctgatctccctcccccaagccaatattgcctggcagacaccttcaagatgctatgggaggctttctttctctaaggagccttttctggcctctctgtgctttggcctttactgaaccccatgcaaatatttacacatctgcttgccccaagctgacactaagcccctcaagctcaaggactgagtctgatttttatgtccccaacacccaggctagtgcctgcctctcagtaggtactacataaatgtttgttgcacaaatgccaccaccttaaacataggcctcctctgggcaaagtcctacatgtgactctatgtgagcccttcctgcagcctccctacagtgcttccagaaatctagttgttcgctgaggttgaatgatgttcccaaggtctgctttttgcctttgtctacagcagggattgtctcacaattacaaattagtcgccttctcattctgtctattctcagtacaccgtggcattctttcagctgcagtctagaaaagacaaggtgaaacttgcatgaacctaagccaaagtgccagctgatttctccccagtttggtaaagacttttgttgttacctgggggggtctacatgaacccagaagggaaacagacactagatgtcagattcccacccctacaggctctagtcatcttccaaagggaacatacaatcctcaaagccaacaaaaattctgctgacttaatgtgaaaagtgagcctgtgtctcagagcactctgaggcttggggagccgtagcagaaatcgcaggaatgataagacttaccagcccacagatgatgattggcaggtgtgtttcagtgcatcagaagtgttcgggagaatgcattttccaaaagacgcatgaagcttggtagtatgttttaccaccacacagaaattctctacttgatcaatctctctgctaggagattggtgaaagccaagacccaagcagtggtgagattaagcgtgtgtgctaaaattcagggtaacatgtgaattgtagcattgccatgagccactgcggaattggtttatagcaaacagacaagtcttgcaatgtagaaaccattgcagaatacgttgaaggatctactcagccaggatccacttctgtcatattctgttgacaacgtagaaggcttttccagaggaagagcatctgattatgatgccacactgagctacctgtgtgttgtccataatgctttgaattcagcatgcctaatactgctccctcttgccacttgccagccatctgagtttccaacagtcggactgtcctgaggccggtaggcatttaactatgagaccatgagtcacttgatattttagaagaaacttaaagtagtaacaacttttatcaagccttgatttgagatggaggaaacattggggatcagcttcaacctaggttaatgtggatattgtcccctaacacagagggggccaagagtagttactaagaggatctgaagtttaaattactgttacagtgtagccacattatagtcaactaattcttagggaaactgaatccaatctagcacacagttcttccgcccaggtctcatgatttaaggcaacatttctcacagttttggcctgactacctgcaagagaattacttgcatgtctgttaaaaatgcagacttgggggaaaggatgaataggtggagcatggggcatttttaaggtggtggaattatattctgtgatactgtaatggtgggtaggtgacattctgtatcaaaatcagtagagctgtaagacacagagtgaaccctaatgtgactttagttaataataatgtattaatattggttcatcagttgcaacaatgaaccacactaatacaaaatattaataatagcccaggagcagtggctcacgcctgtaatcccaacactttggaggctgatgtgggaagatggcttgagcctagttcaagactatcctgagcaatgtggcaagactccatctctacaaaaaatttaaaaattagggcatggtggcatgcgcctgtagtcccagctgctcaggaggctgagacgggaggatcccttgagcccaggagtttaggacagcagtgtacagtctaccttgggtgacaaagcaagaccctgtttctaagaaaaaagtgtacataataatagagcaaagtgttggggggaagaggggatataaaggaactctgtaatttctgtacagtgttagagaaataatctcttaaaaagtaaagtctgttttttaaaaatatgcaagatttgggcctcactaaatacatcttgcgtgtatgaagctgaggccttggaataagcattttggtcaggctctccagaggatctgcctgtattctgaggtttgagaattcctggatatcagtccatctcctttcaccatctgtttcattctaagaaagagcttaaaggggctttgtctagagaactgtctcttgtgtgttaggatgtgtttcatctttcagaaggtggacaaaaagcttcctgctaatgctagaaatatttgctgcaattccacactgacagttgaaccacagtaaagacaattcaggcaagaccagtttcagacacaggaactgtcaattttcgaacgtgtgcagcctttcttcagaagtgtgccctgcctgcgtccatttcaaacaagcgtagccatggattataattaaaattttacatatctctattggtttaagggtgataagtacactattgttataatccttggctctttgtgcatcggagtatgtattttattagggctattataggcctttcaaattaaaatgctcctggactttatatacgtatagatctttttcaaccaaaatgctctggaaattagtattagatggaattttattaaacttgtggaaagtcacattgcattttgcaaaagacacacaaaccttggtagcctgtttcaccaccacacagaaattctccacgtgatcaatctctctgctaggagtttggtgaaagcaagacccaagcagtggtgagattgagcctgtgtgctaaaactcagggtaacgtgaattgtagcaatgccatgagccactgcggaattggtttatagcaaacagacaagtcttgcaatgtagaaatcattgtagagtgtgttgaagcatctgctcagccaggatctacttctgccctgttttagcaaagtcactgctaaggtggggcctcgaggtctgtgagccaactcatgctggatgtgaattttgcacatatgtgagatgaggtccctagctttcactcgtttctccaaagaggttaataagaaagtttaggaatttctgatttcgataatggtctgtaaactggatttggttgtagttgtttttaaaatatatatgtgccatgctattgaaatattgcatatactctatagcgtgcaaaaacataggaatcagaaagatcttgatgagaaataaatatacgtagaagcacttgcgttttcactcctggatcatctgtgctcccctctacagagaccactgcccgggtccagtgcttctttttctttagtgtgcacacaaatcacctggggggtttatggaaatgttgagtctgatttagaaggtctcggatattgctttttaagacagcttccaggtgatgttgaaactactgctccatggcccgtatttcaagcagcaggtagatggagaggcgtgtgttgagttgagctgcagacagcgactcccacgctatctcttctgtctctctctctttcaagcagtcctcagcactggctttaggaagtagaaatggcaaaagtctgtgacaccagttttccctggcgaggctggcagggggcccctgggaccttttgactcctctttaactcaggcccaccttttcctgctgctgcctctgtccccatggcctgctagatctgagcccttgtttgattagcttagcaacatctttgcagtactccccagtgaggtgtgctctgttgactgggactagccagagtcagctccagaactcctgagtgagttcacttctgcagcagccttgacttcctgctgtaccttgaccagaggatttatctgggttttcctggttatctggctcactttgcagcagagaagcaggggctggtgccccttcaactgtgtgttctcctgggggatggctcgtggccattgaagaaactttgcagcagtgcagtctatatgccatggtcacgtcatcctatgctctgaaccaaggtggtgtgtgttgtggccacaggagactgttccaggcttgagtgacataagggaagattttactcacgatgtacattgaactcccaaatcctcctaaaaagaacaagtcgctatcaacttggtgacatcctgaagagctgacagtcctggaggacagtaggaaatcgcataaagggtgccccaattttgcatcaagcagaaaggtaggaaactggttggattctctaagtcacatttcccactggcctctgtcagcggttgttggaagcattcccccaaaggcatgaaggccaaagatgtgtgggtctgtccgaagaattgcccactaagtcataaaaatgaaagattacatttcttacccctcttccacctcacatcctcttgtttcttaactgtgtggattgtgcagtctgtcttatttatggttaaagtcctgttaccacagggaaccccaactgagaaaggcattgtcaccttgggctttctctccaaaggttgttgttggttttgtttcatcttgtgtcagtttggggtgacccataatcaggaagaggcaatactgtgttcttcgcttgaatttcacctttatttgattctaaaatatgtaagaatatgctgtgagtaggatattagagtcactgcaacatgtctctgaacttgtcgtgggggacaaaggttttgataaatatgccacgtttgcctgaacatttatgcctaaaaactcattgaggacaaagtggtttccatgtgtttccttagcaaaattttaagtattcactaaattttagtgctgcagttttataattcgcactgagaaattaagccctttttttttccagtcatatttttgcatttcagagcattctcttcttccttgagccaatgtggccactgcttttcttttcagagaggtcaacttttttctttttttttttttttttttttttgagacagggtttcactccggttgcccaggctggagtgcaatggcacagtctcggctcactgcaacctctgcctcccgggttcaagcaattctcctgcttcagtctcccgagtagctgggattacaggcgcctgccaccacgcccagctcattttgtttttttttgttttttttggttttttttagtagaaacggggtttcactatgttagccaggcaggtctcaagctcctgacctctggtgatccacccacctcagcctcccaaagtgctgggactacaggcgtgagccaccacacccagcaaggtcagtttttttttcaaaaggatgcaggcagctttgttagactcgctggccggtgcatcctcctacgacccggagtgaagttgattcatctgtcttctcagaggccctaaactaaagggattcttttccaggtctgtccagaaactcgatttgcatcctaataaactcagagaatgaatgtcacactgtattataactgagtagaggggcctgtgaaagcatatgatgtttggggatctggatgttgatgacattgctcaacaacaagggcttttcgtcagcccccattagttttttcaatctaatgcaacaaagtatgtgttgatatatacgtccagatatttatattgttattggcaaggaatattacacacacatttgtaattattccatgtttctgtgtccacgtttcaaccaaaagtgtgtccaaaaaatagagacaggctgacgtgtcttcgaagaaaagtaattatgtaggattgatttgttttctgtttgttctttcatttcttgcatctgagaggttttttttttttttttttttttatgtcatgctctattagaaatgcactcgactagagcaagtcggtacgtatttctttccttctctgtcccctctctcctcacacagttcttgacagaggtgatttctggtgagattagtggcagtcagtttgtattacttatgcaggccatgttgaactgtgaactttggaaatgagaagccacctttcgccgcttctgaaggtgactcacaaagccagtttcacttggttccacattgttgcatcattacatttaaagaaagggaagaaatctgtttactaaatgttagacttgaagtctggagtatttgttctagcaggtcctgttagattccacagctttttcatagctagtgtcagttaccaacctattctgtagagaaagttccttttgtaaaaggcatgttgccttcacaggtctgtcttgactggagggatggtgaggactacccttcaagtctggccagctcccagaggtctgggatgactcagacaggactaggaaatggtgtgttctgaaaaatctgtagaagaaagtactgatgagaaaatgcccaccaaaaattgaatacagaatgttggaagaatcgaaaagtcgacgttctctttgaaacagaagccagagcctgttactcattagtaccttcatgtatcccccatcttacaggcagaggcctggcatccaagatgttcaaaaccatcccccaggtcccatgcagcccagttcctagctgtgatcccagtgttctaacaatagtgaactacttacccttctctgaacataccttcccctctgccatttctctctgcttttgcataggttatccatgtgtctagatggatcctcttttggctggcaaactcctccgcaccctttagggccaacttaaacagcactcctctgcgacgctttctcccgtgtgttctcaaagccagtcatgcattcatctgttataccacttttatgtagcagtagagctatttgcatgtcttagtccctagtaggttttgagcttcaccagagcaggaactaggtcttgccactcctgtaagcagctaatgattaggaagtgctccctatatgccaggcactgggctttctaaacatatgcactgtctcatttaacctgccacaatcctatgagggaacttaaactagaagaaattgcgctgaaatgcgacagttgggatttgaactcacctgcctgcgctgggatcttaaccacagctctgttttcctcatctgaacaatagagatgacaataacacttgataagattattttgaaggttgaatgccatgatttatgtgaagcacttaacacagtacccagtgagcatttagtaccattagtgcttactaacaatgatgtatactaggtccttcagccagcaaggggcagagaaggcatttgaacaacttgggtctaacaacagtcatgttccttaaccctgatgctcatgggccaccccagggaagcaagaaaaacaccccacagacaccttgtccctttagcagaggctctgactctttccatccaggggtctctggggaagcttaagaaggtggatgcggagagccgcctccacccacctatcatggcagaactcgggagggtaatggggagatggttcagtagcttagcaactgaggcaagagtccactcagaagacattaggatgttaccagcacctcattaggctccagcactaattatttatctctccaaggagaaggaaagtgtggcatgggtgttctgagattgagttcttggatcagctggttcctttgcttgtgacctcagacaagtcatttcttcttcacccagtgtgagcctcttataaaagctcctcaagtggaggatgaggccatcagtcctctggctccctgaaccttcagaaacacaagcttttttaacacttctgggcaaaagccagtgtttcagataaacacacccgtggctgcttcatctgtaaattatgctttcttaaggccttcactttgttaaggcagtctatattgatgtatacaatagccaattcctatacaaattttggtccagcaaacccaaatttgtatatttttcattgactgtataatacaggagttatttaaaaatatatacagagctgtttgtaaatcattgtaattggtggataataatttagaaacattttaaattaatttcttgagtgtgaggctggctctaaccacagctctgtctctggtgctgtgccgtctcccaaggagagacatacaacagaatttatttcaaagaatattgttgtttaaaaaacagttgaacatgtgtttacatatctctaaaagaagaggtaagttccccattttccttatcactctgcctgccctccctctacatgcgcacgataagtgaaatagacttgcagtcttgaaactagatcattgtcagactagttgcattcacctccctgactttcatttcttcctacagtttgagaaggcagaagatcctgatttagctttgcctttcccctcccctctgccaaaacaaagtcagaattcccaacagcaagcccagctcacatgttcagttccatttcagtcccatttctcagaggctttcccgcttttctggggttgtcgttttctgatacatccacgttgcacccgggtgtagctgggctggggctgcaacgtttctcagcattctgtgtctggaatgctcaccaggccccacagtctggccttagcaggaagccagggttctgtacatgtgggccttgtctacatgcctgtgtgtgtgtaattacccaaccgtgtgtgttgtttcaccagcaataaaaatccagcagggaaatgaatgctaaaattagtttgtttgtcctttgacaagatctccccagttgaaagaattttgtttatctaactggctgggcagacttggctaagatcaaaattaactgccttgcttaatggtgtaatagatggtattttgaagagcttccactgagttctccttgaaaggacgtggggtctagaaagtccagcctctggcaaagttatggcattttggtgtaggtgttttttcctccttgtgctacctgtaggatggatgcccataacccattactctaccctgagtcactctatctgttggagggtggctggatggatggatgatgggtagattggcagatcgacagtttaatttgcttgtcatatgtcttaaatgtaagtttgttaaagcttaagaggaaagaaaacctgtaatcagtgttcttgcaaaaaaaatttgcacagccctatggctgtgtctttgggcttcattcattcatgtgttcattcattcaacaaaaacagcatttaataagcacctagtatgtactaagctcatgggatatagatttgaacaaaataagaatctctgcctgcaaagagcttactatttagtgtgagagacatgcattgaagggcaattaaacaaataattatttaactatagctgtaatcattttttatatttttattgagatttaattcatatatcatgaaattcaccattttatttatttatttttggggttttcttttttgttttgtttttgtttttgttttgttttgttttgttttttgagacggaatctcactctgtcgcccaggctggagagcagtggcacgatctcggctcactgcaacctccacctcccgggttcaagtgattctcctgcctcagcctcccaagtagctgggactacaacaggtgcatgccacgtgcccggctaaaaattcaccattttaaagcatacaatttgatggtttttaatgtattcacagagtggtttttaaaatgataaagttgagtgaaaacttcagtctcttctgttgcattttcagcacaagcacaaacacttagtctgatttactccaacagatttctcattatgttgatattgtgaccttggggatcattaatgtcataaagggaggagcagggaacattggaggtgttgaatttagccacagtagcttagaagcttcctgggttcctcttacccattctggaaggtgcttttcacatgagataactccagtgagaattttcttctctgccccttacttgaacttcctggtctgggcagcctcgtctgcatctcataattctgttcttgaaaaatatatcctaaaaaggtccccagctacaggtagaagaaattcaaggattgggaaccctcagggtcgactccatatatgcaaaagttaaaatggcaagtgcaattaagctttccatgacgtagctcagctgaccctgtttcagaaaaataatgactcattggtcctcttactacatattacttgatttgaaatgtaaaatgcttgcattttcagataccttgcagggtgatctgatggggcccataagggattgaagggatccaagtttggtttctggctctgcccaagttttgctttgccttcctgttctcctctgaagatgagggaaatgacaaaaccagtctcctttatgggggctgtgaggaagccaaggtagatatgaggtacagctgccttggactgagctacctcctactagtggctaagctttcaggaacttgtctggttggtagacaatcagccatctgtacagaaagttccagacatcctccctctcaagaacagcactgatttcatcagaagacagctttgtagtattaccaaaaaaagaataaactagcattagtgttgttcagagttttgtggcaaccccctgaaaacatcagtatcaagggtgaaattcacctcatgatcgtgacaaccgtaatgtcttccacttatatagccttacacaaatttcagtgcactttcatattccttatctcactaattctcatgcccatgttgtgatattcccacatgtcacaggccgtgatagtcctatagcctgggtgaaaaactcaccatccagggaagggactcgcctgtgatggcaaaggccactcatctatcctctctcctttctttccccctctctcaaaagcctgcctgctttttccactcactgttctgtaatattattgcctatgatttgctaatgatttgtcagttccatttccgttactcaggtaaaacacctgcttgtataatcgctgacattgaaaagaatgtcatgaatccatgtgacagttaattttattccctagttcccgtctgcgtcgtaggtacctgtgagtttgggttaattaagctgagttcgctctcttttttcacctttttgttagcgagctggggatcctctaggttggatcagcagctgagttatccttgggctgtgatcagtgccagagcctcagggaatcctccgtttcttcccccttagagcacttggcggctgtacaggcttctggatatgaatgcaagcctggaagccacttgctttggacattcatgtgcatcatcttcttctccttttaaagatacatgactgatggtggacttggcctctatacccgtcgcctgaaccggctccctgatgggatggctgtggtacgggagaccctgcaacgaaatacctccctgggcctcggagacgctgacaggtaagcttgctgcacttggggctggtcagatgcagaggtgatcccaggggggccctgagaaatgagggttatgatattgggagagtgaatggagacttgaacccacagagagggaggggaggcctggaatctgtacctggggttaggagcaggtacagtaggtaggaaagggctgccgagggttcttgagtcctgcttctgtgtagggtggtgcttctgacagcagtaacacagggagttcaggcttgggtggttttggttattgttttgcttgttgctactgtgtctttgtcagttcagcaggccctagggatgtgctttacttcctctctcattagccagctttctaggtattgcaccttgtggcacagaaggtctgtgtgcagaagggatctctcctagccttggctgagcagccttcaccaaaaagcctcctgttgcatggtaataggaggcaatgcttaaggacatgggtttagacaccacatgctaagtagttgacatcatagaggttgatcaggcgtcactgccactgctgtcagggaagaaaagaggttcagaaaatactgtggtaataaaagaggactatttggcctccaggttctagttcttactctgacaaactgattctatgaccctgagcaaccgatgaagtgaggagtttggactatatgatttctatgatcccttccagttctaatgttctataattctggatttcagtgcagatttcaaatacccttaatgatctggctgtttaaggatttgctggaacacttgacttctttccacatctgggttgatgagatgtaacatggaatttagatgcaagtggtttaaaatgaccatagactttttgggtactaaaccttttatgtcagaaagccaaatagtagcacaacaacagcttcctgctgttcccagggcatgctttttacaaagagctaagtgacttctgtaattgtgtggctttagagaaataggacagcacaccaaagagacagatactgaaatcacacccagagatggaatttgctgaagaagaatcttcatgttctctcagggaaggctgggaaacactgaatgagttgttaggaacttgggatctggcccagtctctaccactaacttgaatgtgtcctccttagagtccccccagtgcccaggcttgtgatttatatcagggatgttaaaaggccttccactagggttctagctcaagtcagattttttcctgtaattaacaaagaaaggaatgggtttgaaaagtccatagaaacatgaaccatttgagaaaaaaaagttttttttgtttttttgttgttgtttgtttgtttgtttgtttttgagacagagtctcactctgtcacccaggctggagtgcagtggcatgatcctggcttactgcaacctccatctcccgggttcaagcaattctcctgcctcagcctcccaagtaggtgagattataggcgtgtaccagcatgcccagctaattttgaatttttagtagagacggggtttcaccatgttggccaggctggtctcgaactctcgaattcaggtgatccacctgcctcggcctcccaaagtgctgggattacaggcgtgagccactgcgcccgggctgagaactgctcttactaaggagaaactaaactctctgtaactaaaatctttatagtaaataataacagtaaaaaaaaatcagttgctacaacacccccactggagatttgacaatttgccaaattattttgcttatttgtattcttctatccgttgtttagtaaatctatccacataaaatacagtccttacaagatacagttttccttgtagcagaagaatctatgctaggcagtttaatttaatgcttcattgtaagattaatgggattactatagatcacagttgagcttgtttcctgcttctggagatggaggatgagggtggggttgaaaagataggtagcacttgttaggttgttttagttcagcctgtatggttaaaccaaatggacaacaatgtcctttggttctctccagactggaatgctccgatatgatcatttatttaaaactgaatgagtccgggcatggtggctcacgcctgtaatctcagcactttgggaggccaaggcgggcagatcacctgaggtcaggagtttgagaccagcctggcaaacatgatgaaaccctgtctctactaagaatgcaaaaattagccgtttgtggtgatgcacaactgtaatcccagctactcgggagagggaggcatgagaattgcttgaacccgggaggcagaggttgcaatgagccgagattgtgccattgcagccattgcattccagcctgggcaacagagtgagactcagtctcaaaacaaaaaacaaactgagtggataactgacaaagttttaaagaaagaactcagatggctttttaaagacataggatttgcaaaagactacaaatttacccttgttttacataagttctggcctataggcaaggagatattttccattattctagaatatgctaaatttttataacttccaaagttattatgagctgaccatagtaatacttcatctttggctaagttgaaatagtacatttgtttctgtaaaattctttatgtaaatcgcaaatttagtctcatgtagttacaaaatctatattctaaatgagtgtttcccaaagtgggaggctatcatggtggtataggagatagttttagatggcagataggaaaatactcctttttaataattacattttaattttaatatttttttaaaaacttacaactagcacatcaaacctgtgattttacaaatgctgcttaaggtaaggatagtgtagacttgagacaatttaatgtgaaatatcaaggaagaatatcacaggtggtatgtagttatatcagaaaacaaaggtagtatgcaagtggctgcaatttcgataatactgttcttgtccctgtaattggaaatatgttctttaaacaacttagataattgacccgaattctttcctttaaacctgaaaatcgaaggtcccagagctaaggtttttccaggaagttctgtataaaaagatagcctggtcctttttccattcacacataagcaatagaccacatgagttctacaaaggaaagaggaaaagtactgagtgattagacctgattagacctcagcaaacgaaagaaaggcagatcactgtgtgaataagaaaattaataaccacagccaagcagctggggagaacagctcttccaggaaaagaccttaagggacgctggcctaccaggcagaacttgcctgtttgcagcagaatgtggctggggtatcttcagggttattaaaagtaactgataagaatggatgccttcagagcctgggagatagagactgtgtcagttggtgagtctggtatgttaccagccagcttctaagaaataataaatgaagatagtaaagtgtgcccttgatctcttgtcactctttagggttgccactcctgggctccaggtttttcctgatagtgatcagtgtctacttccagcagactagagccaggtgtctgagaagagaggatcaaaagggacaaatggagtggcttattacacatcataggctccagataacagacagataaaaggagctttggcatggaggtctccaaactggcagactgggaagaagaagaaatatggcaaggagggccaagactaggctaacagacagtcaaatggctcattgaactcctgccagttcctacatgcactgctgtcctctcagaacccatcaaaagttcccgaactccagcaagttgagagctttgatagtgtaaagatcagctctgggaaagttctaaatctctttcttggtgactgcaaagccacaccatcctcctcatccttttctttaccaacctgtgttttagcacacaacgggctgagccagttagatgctcctctcgaatgtcatcccaagatcacataaacgccattgagagcacaacgaggacagaaatcaggcttggtgtgacattagatcaggaggaggactttggaactacttggtaactttcttctaagccgttagaatacttactgaacttcagtgctttttattaatttaggcgataaggccatattacttcaaaccttctaaagacaaaaaaaacaaatgctgtgtggtaaagagtcagcctgaaacttgaacaaaatgaaaatcgccctccacctttgagccaggaaaccaagcagaaaggagagatttttcttttcttcttgttataagtttttcattacccttcaaattctgaatgttttaagtactgagattgctgtttcagtgaaggattcagagtcactgtacagactttccaggctgcatccagggccttggcactcagaggcgtcccagtttcagcttgaattgggaggcctctctcaaggagagtctcatggtgtgagaatgtaactatgcaacctggtatttgagcagcctgccaagctgagccctccttccttgctgggagtgtcataagaactccaagagcccaggacactgcttggctttgtgattcatatggaacaaagcaggcctcctggcaccaagcagtgcattcatggattcaggtctgatctggaggaaagagtttaatccaggccagaggtccccagcctgcagatgcaattggcgcccttaccaggtggtaggtccccaacaagccagttatttctgaagcatagtccctactgagagccacataagagaagcagcaaaaacgggaagagactgctcccctcacgcttcattctaagcctgtggtaggtgtaataatcatccccaaagatggccacattctaatctccagaacctgtggatatgttaagtttcatggcgaggggaattaaggttgccagtcagctgacagggagattactctggcttattcaggtgggtccaacataatcacaaggtcctcaaaagtgaaagagggaggccaagaggaggaggtcagaatgatgtcatgtaagaaggactcgtcatgccattgccagctttgaagatggaggaagaaggctacagcccaagaatgcaggtggcctctatgtaggggaaaagccataggaacagatgctcctagagcctccagaaatgaatgtagccctgcacatacccatcattttagcccacgagacccatgtcagcttctgactcacagaactgtgagctaatcaattttttttgtttttagctactaagtttatattaacttgttatggcaatagaaaactgacataaacttatgtcagcaatagaaaacgaatataaacttatatcagaaggtaataaaaccagtaatagttgccatttcctgatgggttgctctatgccaggaactgtgtcaagcaccttgcaaatattatctcatttacccctgaccctttgagaggagatgttatcctggtttcatagatttgaagcagtggtgctcagagagggtgagtaaacgtgcccagggttacacacctaatgagtgtccaagctgggattcaaacccaggcctgtctgatcaccccccaaatcctccggtcgcctaacatactgcttcttttagggagctctctttgtagagattccctaattttgagttcttaccatggtatcgtctcttcaaatgagcccttagccactgaaaatacaagcaatgcccaaacagctggaaaagtgaactctgtccttcagagacaatgcaaaatgattcacattaagaggaaaaagggaatagttcttgacttgtctccctcccagacctgttgcacatggaccgtgcgagtgggcttgccctcaccccttttctcatcactgttctcagacttcaaggaaaaggtcctttcttacacagagctgggccagttgcctccttggccttcttgcaagtttagaaaagggatgcccatttgtgaattctgacttattgcaatttttgtattgttagttgagggaggagcctgcaatgtcaagatcacaggtcaggggtgatgcttccctttagtgagctaggaattccaaggccaccagatctgcagagattctgcagtcattcaaaaacttttctctcctggtcttggctaaccactacatggacccttaagcaattgctagaggttctctacccagagcttggggatctgtagggcctccagaggctgggaccatggtttaagaagggcaccctaaaataccttccccctccccccattacctcccctctctacttgttatgtacggtctgttcctaatcttcccaccgtcatcaagtaaagcaaaggtgatctctcctctttgaccactaatcccacttcatacaatctctagctgccagtatttgagccttatctcccctacatacatgtggtagaggtgagagaatctagatctgtgctgcctactataatggccaccactatttaaaattaatgaaaattaactaaaagtttggtttcttaatcacactagcctcatttccagtactcaaaagtcccatgtggccagtgctctcctagacaaagaacaattcccacactgtagaaaactcttttggacagcactgatagaaaccatcacagttatattgccaaggaagctataaagaaaagatgtgagttttgctgtaaacatgccctaattccagtcctcactctccatgtcacttaactgccctgagtttaggtttttgtctctgaaatgagggcagtattcatacctgtctcacaggactgttgtgaggatcaaatgaggtgaatgagggtggtgaaagtgtttttgcgaagcacctaagacaaatattttatttttattttattttttgagacagtgtttcactggccccatcacccaggctggagtgcaatggcatgatcttggctgactgcaacctccaccccggctcaagtgattttcctgtctcagcctcccaagtagctgggattacaggtgcatgccactgcacccggctaatttttgcatttttgtagagacagggtttcaccatgttgcccaggctggtctcaaaatcctgagctcaagtgatctgcctgcctcagcctcccaaagtgctggtattacaggtgtgagccactgtgccaagcctccaagataaatactctaattcttaggtcctgcaagctacttaggacaatctaggctctacctcgttgcaactcacttttctttatatttaattaattagctcataattaaccccttttatttctataacagcttataataactgcatttaataaaaagaacaattataaaataaacgagtatagcattaagactgtggggaaatgatgtgcaaaatatgatgtgcaaaaaaaggtaaaaatagagaacacggattgatgaaacacaacccgtgtttcatcccacatggttgcattttttagtaattcagcattgagcttcctactggcccaagtgagaatgaacttgtccttgcttttccctccttccttcatgacttctctcgtattattttgtcttcatcttttcttgctagggtcaatcaattgaccctctctctgactctctgttattctttacctctcattcccagcccttcccctctcttcctctttcattttccttgccttctccttttgtctgccttataactttctgttatactattagtgcccctgagcatttttcagtcctgcattcaagagttatactcattgtcttgggatgagaagatgcttccagcacagtggccagcattaacgatcttcactggtttctttccatcccctttcctcttctcctagttgtgtataacaactagaaacaaagtaagagacagtgaaagtcattttcattttaaagctcataaaaggagccttagaggcaaatgcctgtttcctcagtagcagggtaataataactacattggccttgcccaagaggctcttttatgctagtgccactacctgtaggatcagtggctggagccacaagtgctgaacaagggatggtgctgacaggaagtaaaccatctgtaacttaaaccacagaggaattctaccagggggttataaagagaggagaaggaatagtctgcagagtatcattcttgtgcatgcagtgttttcactttaaaaaggaaagagctgtatggtggcctcatgagaatctctcattccctaatgttgcccaacttcataactttgttccataacttttttacactatagtaaaagcagacctgagggtcagagagagtataatcatgctcctgaagtacttttttttttttttttttttttgagatggagtctcgctctgttccccaggctggagtgcagtgacacgatctcagctcaatgtaacctctgccttccaggttcaagcgattcttctgcctcagcctcctgagtagctgggattacaggtgcacaccaccatgcccagctaattttttgttgttgctttttggtagagacagggttttgccatgttggccaggctggtcttgaactcctgatctccggtgatccacctactcagcctcccaaagtgctgagattacagacatgagccactgcgccccacctgaagtacattttctaaaaatggtaactgttcaacagttgtttaaaggtgattgtttaaacttaatcattgttcaaagtgtggaggaaaagatgtctagcaatatgaaagcaagaataagaggccaaagagaaaggccaagatgggtcacctttctctatgccaactcccctggtcacccaaagcataggccccaatcccaagtcagaatttgactatatctgtgccctgcaatagaaaataacttcatgtgttttaatctgggtacctgtgaatgtttttgtatgagtcaggatagcataggttatgctgcataacaaacaattctcaaaaaactctatttggccataacaggtcagtggaaggctatttgtacatcattctcactctgggatccagagttagaggaactaccatttagagcattgacagtcttcactgcaagaagaaagagagcatggtgaaccacacacagtttcttaaagcttctgtctggaaatgacccacgtaacttttcctcattattggccaaaggaagtcacatggctacacttaaattcaaaggtgaagggaagtacagttataccatatgcctgcaaggagaacagaaaatatgtagtgaactgcactaatgactatcatgcttttatcacatgcaagtgagtgcctgtgcttgatgtttcccccctccccccgttatttaaccaacgccttatcatgcagttcatcacgtatttactgcatgcagtaatatcagatgccaggcattatgccacccagtctgatcacatggcctctggtagctcctctgggtggagaagagtgagcaggtaaaattgtcttcttggtagatgaaggaacataatagttgagttggttaaggaattttattcaatgctatgagtcagttgtatttcaacaaagtatatggaccatgttttcatatgtaatggctcatagaaaatgctggtgattgtttagaatttactgagcacctactatgcaacgggctcttgggatccaaggatgagtgggatgtagtccctgtactcaagaagcttacgatcaagtagagagagaaagacctaagtaagccattgtaacgtgatgtgccaagtgctatagagactttaaccatgtgccttgggtgcagagaggaccagaagcatcggggactgcatatggtcctatactgggaacttgctgttatcctaataaaatgcaggaaatttccttttcctgccagtgatgatgtgaaagatcctttagaaacattacccaagtgtccaatagtcctgcttatctcatcaaccatttgggattttcgttttatttccctaagtatcttttgtcatgttgaaaggtcagcctagggccaggcgtggtggctcatgcctgtaatcccagcactttgggaggctgaggcagacggatcacctaaggtcaggagttcgaggctagcctagccaacatggcaaaaccccgtctctactaaaaatacaaaaattagctgggcgtggtggcgggcgcctgtaatcccagctgcgcagcaggctgagacaggagaatcgcttgaaccgggaggtggaggttgcagtgagcccagatcacgccactgccctccagcctgggcgacaagagcaaaaaactctgtctcaaagaaaaaaaaaaaaaaaaagagtaaaaaaagaaaggtcagcctagccatgatttctgttactgaaatgtaagatctgattgaaataagcccagaatataaggcacttacggtggcctatggaaaagggtccctggtttcactataaccttttgcatttgtcatgctggacagctgtgacacccagagttgtagtgaaccgatgtttctatccaagattactttgtatataaatgtattttcccagggctgtctctcctcagccagttcacaccagatagaagctttcaatgtcaaggttgggtttgttcagaatcatcaattgtagccctgtcattttgccaatgaggaaattgagattgttagtagcccagtgactactctctgtcctctagccttcgggggtaaggtcatctcttgggtttggaaagcatgaactctaagtaactctgatgaaggcacacattatttatttggtgatgattatgaatgcaatccaggcgataaggaaaggagtgcagtaggaaccaaaagaccttgttctatacctggctctgccactagtgaattaccttgggcaagatgcttcccctctctgcacctctatttgttcatttgtgtggtcagcccagctgatctttaaggtccttgagctcctgtaagtcagtgttcttgtttattacttgaagggcagagttaacagaatgactcatgggtatagcttatccatgcagggcagggactctgtgaactgtttgtctctgacggtgatgatgacatgtgtctcatttgatggtatttcagttaggagtcaggttcttgcccaaggcccttcatgtgtacaactccagcaggctgagtggcttcttgcagctggcatgccgtggggccccctcttgtgcaggcagcagaggagaaggccttaaggtgtccattctcgctgtacttcaaagctaagcctagggtaagctgtaatgcacttcgaggtgtttgagagaggtggatagctgttgttgctgatggcaggtaaagaagaatgtctggacctgaagaaccagaatgaaatcttcccaaggagaagtgcaaagaggacagctgcggtggagagtggtggggtcttggacttttctgatgctttggagaaaatctgctattatacattgcaatggattttgttctaattggagcttcaccaaaattatattcagagatgacactcatgaaattgtagtcttgttttcattgagataacaaaattccaagtaactgaattgtttttattttttttgggtgctttgactcaggatttaatcagacttggatgaacgttgttccctaaatcagcactaatagtgggtgctgcctgtcctgagcagggcagtggtcagcctggagaatgggcaatgtcaggtcatttggagggactctcctatgctgtgatttttcatgcagttgacaggctttgcatggtactcctgagtgtcagaggacaaaacagctcttggaatgagttgtaagttacacaaggaaaggataggcttacaaataaggaaaataaggctcagaaaggtgacatttcttccccaaagccacagtgctataaggggcaaagttaggatttgaattaaggtctctctggccacaaaacttctgcttttaatcattgtgcttgcctccctctttgtttaaagagtcagttgttatccttccaaaaagcaaaccttgtttagacctatatgagtaataagtgagcatcccctagggcctagcaccaactgaggtgcttgcaaagccactgcatctggatttctgacctttaagccagtccgccttccaggtatcattttccccatctgggaggctcagcaaaaagaaagcccaagagtgtggctcaggctcaggccaagctctgctattgctgagggaattctatcctttacttaagaagatcttagggatgcttgaagctgtgagtataatatttttctctgaaggacatttaactgttttattgccagaacccccagctgaggcttcagagtttcccctgtcatgttgatcacaccagttgaccttcagggtctgtcttccattgcctcctctaggagcagcctctgctgtaaacccctgtggctgttttgcgtctcagtaatgcagaaagaagaggctagccttgtgtgtttcagctgcagtcctgttattttcgctcgtccactgtgctctttgatttatcttcctcattaatctgtggcgctcagtactgtaaaattgcctgaaacgagatctgaagagagaccctgacattttgagggatgttgcaggattgtgtggaggagattaaatggggacagagggaaatgaggtggctgcatggctcagtgggctcaaacctccaacttgaggatttctattggtacctctttctttagctgaccctgaggtttggagagagagactcacaagcctacggtttctgtactggcaaaataaggcttgaaaaaaattctccctggccgcttatttgagttgcctggacattgcttgtgggcaacctatgagtatgcagtaattgaagccctagagaagatgtgaacagaaccacaggccattgtagtctgggtaggagtctgtcatgtcacctcctatggggtgcaaagtttgacactagaaggtgagtgcagggacgactttgggtgccctacacctaaccagaagctggtggagcactatgtggggagatgttggtgggcctccagggcccctccaacttgtggaagagttttgtggagagaataggttcatttttccattgtcagtgtggtagcaactcatgagagctctgggtacaccagaaacagaggctccttgggaggctgcttaaactctaccgtaggactcttgacagtttgggatcagtggtcctagtctgaatttcatcatcaaaaacaacaattttcattcactgagcacctgctatgttctaggtgttctcctaggtactctacatactagctttaacctcccagaggacttaccacatcaggaattatccatatttcacaaataaggaatcctggctcagtgagcttatgtgacttgctcagggttacataggcagagagtggcagagcttgaattctaacttagggctgtctggctctaaagccagtgttatatcagagacaccaggctgccccatctctaaaaggggagggcaggccgctgttgactagtcggtagatccagcaccaagaataatcaggaaaagcttcctggcatcctttacgttatccagggaatcccgactcatggtccatggctggctatagccctgccttccacactcctccctccaccccaggtaggatcctctgggggctctcatctatccggggtctctccataaccatgttttgttctctggtagcccttaacatgcctttggaacaataagctcctaggtatggtctcccccaagactgagaggaaggaagcagaacaaaagtgtgtttttctcagcattcccaggctttgcacagagctgggcatatacagtaggagacgtttgctatattttaggtaattaatattatcctaagataattgataagactgactgaagagttttcctcccccttttccttccagtcggcaaactccccccaaacagtttcaaatctctcagcttctctctgtctctgtgtttctccctgtctctctgcttctctctctccctctctccgcccacctccctctccttctctctcattggccatggtgcaggggtctaggctgccgtcctctctcatctgagctctcccactgcagccttccaggcccactgtacccaccagggccttcatgcggtacgttctccacccagaagctattgtaaccttaacatatacatcagatctcctctgcccttgcctgaaaccctcccttagtgcctttccattgcacctagaataaaggtcagactccttgccgtggcctccaagggggtgtgtgttctggcccctgcgcacctctccagcctcacctcatcacgctttacctccctgactcctgccttcatccattcccctggacgtgccggatcttctctttcgtcagaagctttgcacatactgtcccctctgcatagactgtgcttccccccctctctccttttctccttataagcctggcttattctcttccttcaggtctcaactcaaacttcaccacttagagaggctgctactgaccactcaatctaaagaaagtttcagctgttggtttctttttggaaactgtttatttgacatctcttactttcatgtgtgttaatttttatttatttgcctgttatgtctttcccactagactatcagtatcaataagacagaaaccaggtcagctccgtttgcaggtgaatcccctctcccagcacagggcccgtccagagagggtgcttattacatataccatgaaggaataaatgactgccaggcactgtgatgcagggctgatgtgcaaaatgtttaaaaccagtgtgcttctggtgccaaccaaccagaatagggcactagccaataaccagaacagggctgtgacccattagaaaggggcatcagtcggctgtaagccactcatgcctggcataaatcaaccctgctgttgtggcacacagtgaacccacccactcagtcctcagccagtcctcaaagagagataaccatggcccaacttgccttcaaaaaaatcgggttattcatgttcaggaacttctcttgtgggagactgactggtttaacccagtctattattgctttgggaaaatgtggggtttttttggatggagttttgctcttgtcacccaggctggagcacaatggcgcaatctcagctcactgcaacctcagcctcccggattcaagcaattctcctgcctcagcctccccagtagctgggattacaggcacccgccaccatgcctggctaatgtttttgtatttttagtagagatggggtttcaccatgttggccaggctggtctcaaattcctgacctcaggtgatcagcccatctcggcctcccaaagtgctgggattacaggcgtgagtcaccgcactgggccaggaaaaatgattttaacctatgtgacactcttacaagttcagatgctgactgtgctgctacgtagaggtcagttaaccatcctgagcccccatgtcttcatcgggctgctgtgaagattaaatgagacagtgccaggcacaaggttagcacagtgcctggtccagtcagtgcccttgatcaatggcagcaatttttatttagtcatgatcagaatgctgatttcacagataaggaaagtgaggcacagaaagtctaagatacctaaatcggccaggatatacatgtgggtcctctcagccccaggtccagcaccgtggccactggcctgtgtcacctccatggtgcagtgtccccttctctttgtgatctgctttgggaggtctcactcagctcttattccctgacctctgtccttggggaactctggcaatgaaaaaaaggcagaagatatttaaggcctgagaccctgatggataactggcaaaacccgaagtagttaacacgctccacatcctggcaggaggtctcaatctttggaactggcagactaaccaccgtgtaacaacatcagaggtgcaaacctgttaaaatccccagcaaaggtcttgaaacagaacatgaaagggtttatgaccctgtggatttgaacttctcatggagccaagctataattccagctctgtttttggaagtaaagatcagaaccataatttgaggagggcctcagagcatgcacttattatgtttcaggacacaagctgtgggatgaagctgcctgggggagggcccggggtaccgaccaggaaggggtgtggagggtgtgaggagagtaaagcagggtgtctagctgaggcaattaaatgtacttgcttctcagtttaaacaaaggcctcaaggaaacctcccagagggctgcgttcttaatgatctggaataaaggggtagtgagcaaagccagcaagctgggggagctaatgggagccctggccttgaatgtccctgcaggaagtcagctagggaggcttctgtacacaagcagcacttgtcatgctaatgacccagcctctctggtgccacagaggtcagctctgagacttcaggtttgagctccactggagagctgggacgaacgcttcctctccctccctcatccactgctctgtagcacgtccttgtgtgctgcggttcctggcactgtctctctgctctcactgctactgtcctgctgtgcccgtcctgttacccagcgcatcatcccagcacagccacagtgatcctcctgaaatgcagatctgatcctgtgtgccacctgcctgctgaaaaccctttgtggctctgtgtcacatacaggataaagtgcaagcctcagagatgaccctccagccttggcccctgctatcacacccgcctcgtccccaacatctaagccggctgcaccaaacacttggcagtctctagcacgctccggggtattgtaaacctccatgcctttgccccctgggatgccctctcctgacccttctttgccaggctaacacatcctcttcctggattcagctccaatgcccacttctaggcatctcaggcctagtaagtcccttcctcagggctcccaaaggaccccgtgctatcctttattttaagtctaaccaaatctttaccttcttttttcctattttccctgttgcttggcttgaagacagggattatcttatttatcactgggttttcaggacccaaaaatatgatgtctgccacatagtcggtgctcattcagcacttactgaaatgaactccagttttagatggatgggttatctctctccatccagagaccttggctttttcactatgaacactgttgtttttctcactctcaggactgtctcagcccttagcacagtgggtgacacagagtaggtcttcagtaaacatcagggcaagccaccgcatgttctcactcataggtgggaattgaacaatgagaacactcggacacaggaaggggaacatcacatactggggcctgttgtggggtggggggaggggggacggaaagcattaggagatatacctaatgtaaatgtcgagttaatgggtgcagcacaccaacatggcacatgtatacatatataacaaacctgcacattgtgcacatgtaccccagaatctaaagtgtaataaaaaaaaaaatcagggcaagcctccctgagatgatgtgggggtgtggctgtcccacctgttttaatccattcaggctgctataacaaagtagcacacattgtgtggctataagcaacaggcacttctttctcacagttctggaagctggaagtccaaggtcaggatgccggcatggtcgagttctgatgaaggccctcttctgggctgcagaaattcggacttctacttgtacgttcacatggcagaaagagggcaagctagctctctgggatcctttttattaggcactaacttcactcacaagggctctgtcttcatgactaatcaccttccaaagactccacctctaaacactatcgcattgggggttagatttcaatgtgaatttggggcatgggaaggggaattcagtccctaacacctctcatcaggcatagtacttgctgggaactccttgtgtaagaggtgctttggggacacagaggcctggagtggagcctttttcaaagatcccaaagccctctctctatctcagagatcaggtcgtgagcgactaaaggaagggacagcgcagtcagggagatgtcagtgcgttcagattcagagggcagaacaagagcactgtagcatgggtcagaaggaaggcttcctggaggtggtaggcttttagctggaccttggaaaacaggtgggagttataggtggtgagggagagaaacagcagtcccggtttggtagaaaggaagacagaatgtgcgggagggatggagaaaagagactgagcctggggagttttgttctctgggaaatcctatcgttgaaggccaaccacttgttttccaggccagtaggtgccccactctgatactcaaagccactgtaatagccacctccggtagctgtgttccactgtgcccttcagaagtaacctaccccagcgcccctggaactgtctgtgtcaggggtcagccttgtgttcttggagagaagccttccaaaaacagactctgataggttgaagcaaatagctgacttattcatagatgccctggggctcacagtattagaactggccacctcctaatgattaaacactacacaaacacccagtgaccagattaccccaccataaatgggctgtaaaccagagtggacagtggctgttccaccaactgggaggaagcgaggctacagaaatgctttctgtcctaagcaactagcccttcaggcagagcccagaaaacaaacgcagacctttcctgcaccctgggagggaagtcggagaggggaaaggtgggattctgaggtcactgagagtggaaaatgacaagtacctccctcccctcccctgtgctaggtgctctaaacatgctgcacattaacttacatcataacctggtgagaactggcaattgatcaggatggattcggatgacatctgtattgagggtctattttatctgcatatccatttatgaggggaaaaactatggccactacccttaagttagttgatacagctgattcagagagactaggtcttttgtccggaatcacacagcaagcaagtgactagaaacaggaccagaatccgggtcctctgaccctgcaatacaagccttctccattatctgaaatgattatactgagcgactcccaggggtaaatgactcagcgtgccaggtgtgggacactgcctctcttgttctacccacacccacttccctccatctctaagttagttctacttgagttcagcaggtaaaagaatcacccctgctctggtttgttgcctctccaggaaggaagcaactggaccctattggtgggaaaggtgagagattcacatccacctacctgcacacctcccactgttctggacaggccagaccagggctgtgggcatgaagcagaccctcaccagtctctaagagctggggatgagaacaaagcccttccttattgctagcctgaattattgggatctgttgctcttattcttcagtaagaaaaacagccattctgttcattggatttggatgttctagcttctggttttgttaaattgttaataatactatctatttctagttactgctagaaagtatggaaggctcatgtgagttcaggaatatttgagaagaaaacatcttaggaaaattgcatccagtctgcataagcccgttctcttaacttgctggtgaactcctgaaaattggttcccaaacaccaggggtctttaaactccagagatggagacacctcctgaccatccagaagctcacctggaattcctagtagcagatgttattacactggtcctacatttccctccatatcacctcaaaaggcttaatttgctattttgtatgttcaccagaacagttagaattgtgatgccaaaaggtggtaagcttgccaggctaaaatatcctcaggaggaatctttaatttcacaatccatgtttctggtgtaatccacaccttttttgtgcttcagtttccctttctgtcaaatgggcatgtaaagtcctggtctctcctctccccactgccgtaagtcaatactggcgaggagcttacagcacccctaggaacccaggggcattgtaaatgcagggctctggccagagaagcctggcttctctctgctgccactgaagaagtgactgcagtgggctctgatgctgggcagttttggtattctgatcaggttacagtgacttttttcagaggggctcagtcctgccattctcacataaattccctctccctcccagtgccttagtgtaacttaagggggtgctgaaagaagatagcacctaaatccactgggttgcttttcacattacaaacatgaagccctcatcatggactacactggccttggttgttgttccagacaccaccagatgtgttttagggagtcagggtttctcgtctgccattccttttttccaatccttcttttggtgcaagaccttgaacccaaggcagtatagcacagtggttaagagcaaaggctccagaatagggttcagctcaaatcccagctcagtcacttgctaaccagtgaatgacttggagtaaattaatgcagatagtaagaagtgcttcttggtggagttgtgaggcttacttgcgataatcccaataaacaatagctattattgggaaggaagtttaagctccaaggcagagcaggaacggaagtgtcttctgattcattctcactggcccacaagctctctgacaatagagaccctttctgtctgtcttaacactttaaagccaaggcctgagaagaaactgccacacgatagaagttcaataaatgtttgagaacaatttcaatcccaagtgattctgctgagttttaatcatatatatatatatatttttttttttttttgagatggagtcttgctctgttgcccaggctggagtacagtggcacaatctcagaggaacctctgcttcccgggttcaagcaattctcctctctcaacctcctgagcagctgggactacaggcgtctgccaccaagcccagctaatttttatatttttagtagagatagggtttcaccttgttagccaagctggtcttcaactcctgacctcaggtgatccatctgcctcagcctcccaaagtgctgggattataggcttgagccactgcacccagcccagtcattctttaaaaaaaagaaaaaaaaaaaaaacgagaaatgagtcctatctgtaataagacagattttcaataaggagaggaatacagggacagggaatcaacatttctgtgcacttcattgtgccaggcagtgagctgaatgctcaaagtatttcatctcacttcacccttcagaactcctgcaaggctggtgtgtccttcacttttcatgccagaaaactgaaatgaggctcagagaagtgaacttgcctgaggtcggacagctgggtaagctagaataatagtagaagtagtaatagcagcagcagcagctaacatgtatgtagcatacactgtgagccagacactttacctaaattgactcatttaatcctcatgacaactcagtgagatttcatcattttaaagatgagggaaccagctgactgcagtggctcacgcctgtaatcccagcatttgagaggccgaggcgggtggatcacctgaggtcaggagttccagaccctgttactccctgttcctgggaatattcactcagaatctggaaaactgtatatccccgacattacagaaggggttcctgcgtgaggtgagaaggagacagagaggtgatctttcaaaggtctttcagttgtatgattcagggtgtccaggttcccatagggatcattagggtttgattatagacaaagcagactgggtattgtattctggagataagggcctccttggaaagccaggttcccacaggtcatgccagcctgggggtggtagcagaggcaccaaagatgtttcttctgaaaaatgtttaacccatgcctccttctattaaatataaaaattgtggccgaatgcagtggctcacacatgtaatcccagcactttgggaggctgaggtgggtggatcatgaggccaagagatcaagaccatcctgaccaacatggtgaaaccccgtctctacaaaaaatacaaaaattagccaggtgtggtggcaggtgcctataatcccagctacttgagaggctgaggcaggagaatcacttgaacccgggaggcggaggttgcagtgagccaagatcgcaccattgcactccagcctgggcgacaagagcaaaactccatctcaaataaataaataaataaataaataaattagccaggcatagtggcacatgcctgcagtcctagctagtcaagtggctgagatgggaggatcacttgagcctgggagattgaggctgcagtgagttgtaatcataccactgcattccagcctgggcaacagagcaagaccctatctcaaaaagaaaaacaacagaggaccaaggtacaaaaatgcaaaataatttgcacataattggtggtagagctgagactggaccctggtttctaaagatcattttcttctttttttttttctttggagacagtgtctcactcttgtcacccaggctggagtacagtagcacaatctcagctcactgcaacctccgcctcccaggctcaaacaatcctcccacctcagcctccagagtagttgggactacaggtatgcaccaccatgcccggctaatttttgtattttttgtagagacagggtttcaccatgtcatccagtctggtcttgaacttctggactccacggctttggcccctcaaaagtgttaggattacagacttgagccactgtgcccagcccatttttagtaagggctttattggtgtagtaaggactccataggactttctgaaacagaagaattaggtgattaagtaaaatggtggcactgctctctctaacagttttgaaaatgagactctgttcatatgcccaggatgtgtgaacagaatttttcctggaggtgcagggcaagtttgagaggacctttgagtggccttgaggctttgcctcatctctccacattgattgggttggcagtattttcactgaagaaactgatctgcttttctgtggagtgaaatgacaggttagaaaggctctcaaagtctaaatttagccagcacagtgtattcatgtgctgttttgcacccgggtcaccaggagaagatagatttgacaggttggctgggggacaaaagccagcccttgaagaaatcagttctcctttgaaaggtaagtcagactaattatttttctctatcaagcctggtgtgtgagctcattgatcagcagctgcaatgggagaatggagtggtggtactaggaggcacaactgccaccactatggggcttcagctgtaatcatcttccaagatcagccagtggtacagtaactgcctgctatccccgcacacactttagatcctttgctttatgatgctgttttggatttgtaaaaacattttatgttcacaaaaacaaaaaatatttttatagaagagaacgttatcatactttaccccttgtagaaatcttgtgagactggtcattgagagagccttgttttatagagcaaagttgcagaaaccaaatattgcagaactgtcagcctgtgtattttaagtttaaatcaggccaggcacggtggcttatgcctgtaatcccagcactttgggaggccaaggcgggcagatcacctgaggtcaggagttcaagaccggcctggccaacatggtgaaaccccatctctactaaaaacacaaaaattagccaagtgtggtggcgtgtgcctgtaatcccagctactagggaggctgaggcaggagaatccatgaggccgaggttgcaatgagccgagatcgcaccactgtactccagcctaggtgaaaaagtgagactgtctcaaaaaaaaaagtttaaatcagtgtatgtgtatgaatgcctgtcatcttctctgtcttttctctatcactttgactcttttcagctacttcttgaggtccaaaaacttccagagagcttttcctgccccttaacagccaaacagagacttcagggacacagcaaacaagcatgcttgccatcagcatcttaagcttgacccttaggatagaggctcagatgaaagtcattcacaccaaagctgtgtccaggcaacagccaacagactttgaaaaaggacttaaccagtataagagatgactaaatttagacttgtgtatttctttttctgttgcttgtgtctttgatccacttggcagttaaaaattgaagttcctcagaccttttttttttttccgcctgcttgttttgctagataaaccgtttgcacagagtggtgtgtgtgcttgcacatgcttaatttccctggcatctgataaatgttttgaaatagaataatgctggaaacattttttattactttaaattgctttgcttaaatagaattgattcttttcctcgactgctgtattgttgctgcttttgtttttaaatgaataagatcactctaactacgtttccttcttattagtcccatcgtgttcaaccatcacttcctgtagtgcttactggcaaatgagacttcccatcctcacgtggctacacaggcatcagtgagacctctctgaccttgggctaggaatttggaattcctggtctgtaacggggagagatgaagctgcaaaacaaaaaagcataggttggaggttggaggtctgaggtttaaccttggatctatccctaaactctgtgacctcaagcaaggtacttttccccctgagcttacttactcaaatttggatttgagtcaaatggcccctaattttcttttcagttgtgagcgtctagagtaacttcagtttactagataaccaaccctgtataaaatttgagatttgattatccaaaatgaagtgcatgaaggcaggtgctcgttgaactcaatggtgtctgaacgagctctagaacctgtgacaaatgagctgtgagatagtgttatgatttacagctttccatggggtggacatcataatttttaaaacgctgactttgtcagagaaattagataaaatgcaaacagcgctgtgagatttctgaattgggaagcagagctggagtaattttcctttggtatgtctgcatctctgctacccatggcttttccaaaagcagtaaatgcctgtctatgagcttccgatcccccttggataaagttcaaactgttaccgggcttactatgagatctggctcctgctattcttcccctccttctcctctcttcaaccacactgaattacttgcttccccaacgccccaaaccatcctttttcttgccttccaatctttgcagagacattctcttcatcctcaccccatcccttcagggctcacgttaaatgtcacctcctccaggaagccttctctaccccacaccaaagaccagattgggtgtccctcctatttgctcccatgatggcctgaacttttccttatcatagtaccaaatacatcctattataactgtctgctactagcctgtcacctcatctatactctaagcatcttgagggcaagaacctatcttgttcaccagtgtttcctcattacccaagccacatgaggaaactgctcagacaggtagactagctccagtctgtatagctcagcttattagtgaagccagaattcactcccaagcctgcatctctcaaaccccacccccttcccttctgtaagacttctcatcctgacccatctttcccctaattgtgaagatgtcttttttcttgagatggcttctgtgatctcataagaaggactggggggaaaatggaattggttttgcagacctttgatttagagactcatttacaagattgtctgctcccgtggatcaggactgcaaaggagaacacttaggtcaattggcttaaatggcactgcgtctgctgtgcaaataggggcttaataattgtgagtctccttttctccctggagtttgacatactgtgccatccagatgcatttgtgagataagcgtgacagccccccaccaccttttttttaatttgcgaattttgaaattcaaacacgcctctctgtctcttggattccaacagctttaaatgtccttggattttttagaaagcgcccaagtctataatatatgtacagccgtggcttttatcaaaatgtagacatgcctctcattactgctaattgcagttctaccaccgggtgatctgggctcaaacctcctagttctgtgactggttatctgttttatagcattggctacttaagatacattacagtgtcttccaggcagctgctctttaggtaaattaatacctggggatctttttccttctctaggaaactttaagtactgtaacaggctttcatttaagcctgtgcaaggcttatttcaccagattgctatttagaagttctaacaaaacacctttatgaatagtgactgtaatacccttaatccgctaaacttcctgacattttaaactaagtggatagctaggaatgaaatcaggctttcccatctctctagtctcttcctctccgcaggcctgcctatgcatcttcaggatcaaggtgctggggtgcaaattctttcttgctgttaggccatcaaactagcaaagacgaggaaacacaatgcactttcttcagactccaggttttgtaattacctggcctgacccatagcttttttaaaaaaatgagttttggtgaggtttctgtttctgataaaagattgggatttaaaaatattaaatgtgattttcttgtttttttttaagcctatgtttaattttggaaaaaatattgaaaatgcagataagcaaacaatagggataaaagaaaaaggttgtaatgttatatgacacagagaaatctatcgttaacaccgtggtgctttccaggtgttttttgttcatgtaagcacttagacattttgttttttgaaagaccaaacatgtcttgaatacttgcttgcaatgagtcacacactagtttaaattctttacatgtattgattcatttggtgtttacaacacctctgggagtaagaactcattgtacaggtgatgaaacagacacacatcgcttaagcaacgtgtccaaagtcacacagctaaaagtgacagagccaggatttgtagctagacagtgtgactctatagtctttaattttaattacattatacagcctctaaaaaatgagagatgttttataatctaattttgtaattgtgtagtacagcatgagcatttttctttatcaggattcattaacatcattcttaatggtcacacacaggattccattctatgtggcggagccataatttgattaactgtcttcctactggtgaatatttagggtatttcacttcttttgttcttataaacaaaaatgcaaagaccattcttggacctaatgtatgcacactagtgtgggctgccaataaagcttgtattctatatttcccttataattctgacatttgtgtgtgcagatgatgcccttgaggcactacagaggagcatagtctcgagtatcttctggcagtggtgatggggctaccctgaaccattcacatactttttctatccgtactccattgttcctggtatggtgtttggaagaaagttggctgaagaatggagtttctgtctaggtccagctagctccctgcagctgaacctccacatatagcatcagtttacattgtgctctgaattgaatgagaacatttatctttctctctaaacttaagcaaaaatatagaacttgaaactattaggttggtgcaaaagtaattgtggtttttgccattactcttaattgtgaaaactgcacttacttttgcaccaacctaataccatgatggtgcctactgatagaatcacccactcatggccgggcacagtggctcaagcctgtaatcccagaactttgggaggccgaggcaggtggatcacctgaatcaggagttcaagactagcctggccaacatggagaaaaccaatctttactaaaattacaaaaattagccgggcacagtggcacacgcctgtaatcctagctactcgggaggctgaggcagaagaatcacttgaacccaggaggcggaggttgcagtgagccgagattgtgccactgcactcaagcctgggcaacaaagttagactccatctcaaaaaaaaaaaaaaaaagaagggggaaaagagcgaccaggggatagggttgttgtcaatacacttttaatactcaaaccagtgaagtggctgtctgtaaagtcaagaaaatcatccccaatgtgccaattaccagtctcaaggcaaaaatccagaggtgataaagagtagttttaagcatgggctttgaaatcagaagcctgggggcttaccagcagtgtggccttgggcatcttacttaacccactgctccccaatttcttcatataaacttgggatgattatacctactgcatagggaatgtcagaaggatgaaataagaccagaaaattcagcacagtaaacaccatgataagaactccataaatgggagcttaagaaagccccagaaggacactgatttatgaataagttggacctgggtccagattttggctttagcattttttggctatgtgaccttgagcaacttacttaacctctctgagttgtagatcatctgtatatgagagataataaaatctatcatactgggatatgtgagttttgataccaacgttgtatacaaagttagtagagtctctggcgcgctgttggttttcagaaccaatagcaaaatttgtaagtactttctgtgtgccagtcactctatttaacttctcttcttccattcaaaacagtttttctcttagagactaatggtcaaatggaaggagtttaattcttaaccagtctataactttttcagctagccttcccgctaggcaaatacctagaatgagttgggctctttgccaaactttttttttttttcctttcattgtagacaagactgtggttcagaggttgggaaaggttttgtgaacctattttatagtccctataaactcagaagggaaacaatgaaataccaaagctaaggtatagaacaggttttcttacaagagaaattacgacctcatggagctgtaggaagggttctgcgggaaaaggtatttacagcatttcatacaatgcccggtccctagaaagtctgcagtaaattcaaggtctgtccccagtaggggacagatggatcatgagtcaaattcacaaggcaaatgaattttcttttgagaaggaattcagtgggagatctaggggtatagttttacaaaacattcatacttggaaggttcttagtggacctctggggtggcagcctgctcagtaagcaggagagtaatctgagagccacagtcaggaagtgatttggccaaagtcaatgtggtgacagatgtaggggctcagccccaagcttctgttctgttccggtgttctctcctctgccctgcagcgcatcctacaacatgagggctgcatgaccggggccagtgggaaaactttgggtgaaggaagtggagtgagatcagagtccccaactgttggcttaagtcgcagtctgcctaggggctgccaatgatgagcacctacaagtttcctctccaatcccttccttctccccgattacacttccccctcctcaccccagccacctgtccctctccctcattatcaccctgtggtagacacagtcaaggatgtccttggagctggactcccattggaaaaagccaaagagtagcactgaaacattttcttcattccccatccatcttaatagagataacagtgcagctgcaaaaataaacatttgaactctctctgtgcccctacagcacccttaataaaatatagatcctcaaagcccatcatgttcttttaaatctcctttaattttctgtttaaaagaccatggctaggtgtatttggtcatgtctgtaatattccagcactttgggaggccagggtgagaggattgcttgaggccaggaattcaaaacccacctgggcaacaaagcaagaccctgcctctacaaaaaattttaaaagttagccaggcataggccaggtgcagtggctcatgcctgtattcccagccctttcggaggccaaggcaggtggatcacctgaggtcaggagttcaagaccagcctggacaacatggcgaaaccctctctctactaaaaatacaaaaattagctgtgtgtggtggtgcacacctgtagtcacagctacttgggaggctgaggcaggagactcacttgaacccgggaggcagagattgcagtttgccaagatcacaccactgcactccagcctgggtgacacagcaagacttcatctcaaaaataaataaataaatataaatataaatataaatataaatataaattagaggcatgatggcacatgccagtagtcccagctactggggaggctgaggcgggaggattgcttgagcccaggagtttaaagtttcaaggagctgagattgtgtcactgcactcctgctgggcaatagtgaaacactgtctcaaaaaaggtagttaattaataaataaaagacctaattgccacatggatttgcttctttgggtttttttcctgttttcctctaaataaccagatttatgatcatgaccaaataggcacgatagcctcacttcatactgttccctgaaatacgtgtcgagcattgccatctgctgctactccttatggccttggagacaatgacacagaaatttttgtggctgttgttcttagccagggatgtgtgggatggggttttatggggtaatctaggttttgctatttagaaagctacatctagggtcaagtttcaagattttcaccaaaattgtcaactttcaccattgcacagcattcctatacaggcagcctgagtacagatttttctgactttgtggacaataatttccttctcttcttccctataatatgtcctcacagtttactatttctttttttctttcatggcatatctcatggattgcggttaaatgtatttgttttttatttgactgcttggtacccccacatacacccaattataagctccacgagggggtagagagagacatcttctctttgacataccactgtttccccagcacaatgcctggcacacaaaagtcaatatccagctgatattttaaagagaacaatcactgcaaatataggaggagcgactatagtgtggaatttggtaaatgacagtatctcaattggaccaaacccaaaagtattagaaggagctgaaggactgtgggataacctgtgaatggccctggcccactaagtgtcttagtgtcatctgttggcatagtgacctggaggtgttcactcctctaatgccgtgtcacggaaatcaaacaggatttggctccagtctgtcgcttggcagttgtatgactacgagcaaatcatctaaattctctgagcgccggtttctttttcataacatggggataataacgcgtgttagaacagttcttagaattaaatgagatgagatgtgtaggcagtaaagcttataaagtttaattatcgttattgttgggagtaacttcgacctcttatgtcctttactggaaatgctgccattttggagttgatatagccgattggcacccttccagaaaagacatccctgatgttggactgagggtggaaagtctggatttgtgagttgaggctgaagatgctggcacccacatggtcctgttccttagctgtctttaaggttttgttaacaatcagctggtttcagatttagaatgggaagggcataagcatggataacagattggatactgttcctgctgaatgaaatcttttgtttagagattaaggaatatgtgtgcttttacatgtgagtactcacaaatgtggagtccagacaatctcaacaattaaccaacaaaaggtaacagaaactgcagctctataagataaaatatttgaagctgaaaggcagctcattctgtttttgtaatataattggagcacagtatcaccacttcactggaaacagtagggagggagggatccacaatctgggtaaatgcaaagagtgaggtcctgcttccctggacccagtggaaatagagattctgcataagaacatgaatagggccaggtgcagtgactcacgcctgtaattccagcaccttgggaggccaaggaaggcagattgcctgacctcaggagttcaagaccaacctggcccacatggcaaaaccctgtctactaaaatacaaaaaaaaaaaaaaaaaattagccaggtgcggtggcgcacacctgtagtgctagctactcaggaggctgaggcatgagaattgcatgaacctgggaggtggaggttgcagtgagctgagatcgtgccactgcactccagcctaaacaacagagcaagactctgtctccaaaaaataaaaatagaaaataaaataaaagaaaaagaactttaacaggaagggaggccctcttgcttatcctttaggtcctaattcccagaaaagaatagaggaagtggaaaaggaatgggggagatgcagaggcacactgactacctttcaaagctctttattgatacttttctaggatcagttgttattaatggtttgagagttctccagaggatagtctttcttttccactaatgtccccacacccgcttactaagcttcaaacatagtaaccacctttcagcccctccagcacacccagcctctccctctggtctctgcacttgatgcgtcccccttccactccccaaccccttcgtctggaacacctggctttctccttctgatggctggttggtgccctctcatctttcatgtcttcctttaaatgtcacttcctgggaatggcctttccctaccacactatttaaagtaagtgcttcctgtgtgactctctttcacagcaccctgtttatttctgtcatcactttccccgtaacatccataatgattttgcttgtttgtctcctccatgtaaagagctctgtcaggactggggcatttccttttcctccgccttatattctcagtgtccagtctagtatctggcaaaggttttgcattgactatttgttgaatgttgttcattttctaccccaaagctgcctagtttcctataattcttgttgaaaataataaactccctagtattaactgctgtacttcaaaatctttgctaaagactctccttcccactgcctgttgcagatcacacccagtaaaattccacaccaggcaatgtgatgtgtgtcacatcttttaatgtgtcccatacacacagatcctcttttaaacctttatgttttccttcttgttcattcatccaggagagctttccttcctccctccctcccttccctttctctctttgttctgttactagcaagcaagaagaaagcaactgaattgagtataatactgattcccaaattaaggaaacaaaaagtcagtataaaagtgaaactgccaggtgtggtggctcactcctgtaatcccagcactttgggaggccaaggcaggcggatcacttgagatcaggagtttgagaccagcctggccaacatgatgaaactcagtctctactaaaaatacaaaaattaaccaggaatggtggtgcatgcctgtagtcccagctgttcgggaggctgaggcatgagaatcgcttgaacccgggaggtggaggttgcagtgagctgagatcggcccactgcactccagcctgggcgacagagtgagattccatctcaaaaaaaaaaaaaaaaaaaaagtgaaactaaagtggtattacaaaactcagaagcagctgcgcttaacctgggctttatggacaggattcaggggatcagtgagtccctggaaattctgtgtaaaatattgtttgtgtatcttttttcttatggagagacgggcccctaagtgggtctgtgaccaaataaaaccattgaactaaagtccttggaagtactacacagtccccaggagactgcatggaataatcagttccattttgtcctcctatgcttggttgatccaggaccacatcagcagtgatttaggcactgggaggatatggctcagaacaaaggcaaacagtacacctgtgctcgaggagctccctgtgttgagggaaagacagactgttgaaagacaatgtgttgactggttgatgccatgaagaaaatcatatggtggaatgtaattgggccagagtctaagaggaaatccctgaggaggtgccattccaaccaacatctgacccgtgagaagtgggccgccagtgggagacatggggaggagcattccagaaaggaggcacagtgcgagggcctaggaagtgggaagaagcttggtgcatttgtgggtcctgtctttggacgtaatgaagaggagaagccagatcacatcagggcttctaggccaagggaacaaatttgaattttattctaagttccctgggaagctatcagtgggctttaagcaggaatgtgacagaatctgctgtacactggagaaagattgctgcccctggggtgtgcaggatggagcctagcaaggcatgagggaaggctgagcgacccgggaggtgtctgttgcaggaaagagatgatggcatcttggtccaaggttatcttattgcagatgttcagtagtgattgggttcaaggtatatttggggactctaggcaaaaggccttcttaatggattacatcggaggcaagaaggagggagagaattaggactgttaatgtagagtcatattctgagatacagaagactttgggagtgggggtgcggacacattggaagttgggagcaatagttttgagtaaggtaaatttgatttcagatgtgttgggtacacaaaggggccaggctagagattacagactttagagttgtctgccttcacctagtatttgaagccatggatgagatcacccaggaaaagaagttagttagaagtggtagttataacttagttagaagttagtgagaagttatagttagagaagaggaggggtccagggatggaggccctggagttctggagaggtgaagaggagggtgagcctaggagattgagaagcgcagttagggaggtaggaaccaggtacagatgacagtatggaaacccgggatgaggcccactcaagaagggagaatctgtcgatgctacctgctgctgaaaactcaagtagggtaaggacagagagttgaccattggctttggcaaggaggaagccattgatgttctcagggaaaagagaaagtggtctcagtggagtagtgggaacaaacatcttgcctggtgggttgaaggatcacggaacatgagaagtacaggaaaacacctcaaaggagtggaggagaatatgggcatgaggtaaaaaaaaaaaaaagtttttgtttgatttgatgagattagtgatatatttttcagcctgcagggaaaagccaggaaagagggttgaatatgttggaagaaaaggaacgaagtgtcttcactagcattgttttcataaaatactcattagaaataagtgaacatctttttagatttgtggttttctgttttgtctaattatgtactgtattccaagaataaagttttcttctactctttgatacctgagtagagttcatcaactacatcttggttttatagatggctctgtgagtaacctggaaaccttaacatcactgataacattgtttctgtggagaaaagtgttatgagttctgggagccctttggaatttggcctgtttagaagcaagcgtcaaaaatgacagagcaatcctggctcttgaaaagcgccaaagggcatctgccctcatggagttggtttactttcccttttcctctctcgttgcctgggtctcccttatccctactaattattatctttcaaaccatgagaaaaccctgactcaattagaacctgtagctgcaaataattcagagcctctaacatgaaaggtgtgattcttttaaccatagaaagaaaactaagacctccttaaagcactatgtctcctacaataaactcacccctgtaaaaatcatgtgtaatcaaaacgatatgtttagtgttgtacatttacatgaacttttataaaaagaagaaactccatctattaaacctccaatgtatcctctctccctcagagtaaaagacaagctgcttacgctgacttgcagggccccatttaggcactctcctctctcgctgtacccttggactctctggcctgaccccctcctcaccccactttggttcaccgctcactgctccagccactcattcttggaatgcattgcaagtcgtatactatctcagggcctttgcactgaccatttcctctcttgaaagtcccttatccccaggtattcagatacccagctcccatacttcttttagatttgtaataaaaaccatgccctcagcagacctgccatagccagcccatgtaaaatttcccacaccccaccttgacaaatcacatcttcttctttacaatacgttgttctcccgagcatttattgctaatgtactgtaaaatttacattttgtctcatttattttatagttctaccactgaagctaagttccattagagttgagatttttggtctattttgttgactgcttgtatcttctgcacttagaacagcacttgccacattgcagatgctttataaatatggtagttgatgaatgaataaatgaatacatcaacatttcctagcttaccttgatgacaaatcagaatgtttacctattatgtttgcctagagcgaggaaacaatggaaactttttagagcgtgtgtgtgcatctgtgcccatgtgcctgtgtgtctccatacacacaatcaccatcccattcccaagttaactcggatgttggacagattctcaaagaagtaatatcgtaaagatacagtcagttccagggacagcatagaaggtaaggggtggtttgaagcatccttgtcagccagaacttgggtctgtcccaacttttttgtcttaatatatctggacactactccttccctcaaactcacccactgcccacccccacctctgcttcccactccccacggcagatgcctcagcagtatttcaagtggacgagggccctgaaggatgagatgtgaatgattaactttggttgggactccttcgagattacaatctttttttcattcacctgggaatcaccaccagaccctcctctcctctttgagcagatcttttattccctcccttttcagtgggagaggaatggctcttcattcccctttgaaagcttctgtttgctgagcaaatgctgaccacacagagacctcgcttggagccagttactgcttccttccctaaccatcccccagggccacaacccccgctccctgcttccactggagaggccaccctggccagggggagagcctttcttggggaaagtctttgaaagctaccaggaaccaactggtaggatttttggagagggagtcagggttttggagaacatcttaatccttcgttttcaaataaagcttgtggctataacataagtttgcttttgagttctcagtagtaatacagttgttcattgttcatagcatctgtttacatagttctttctgagtgccttgattacaggttttaatagggattagtccatgcaaccccttcccatcccagagctgggactctctcccacccacctccccttccagcctctgtaccataatgtttaatgtagccatgcctagactgagattctttttcttttgaaataagtagcctgcggaattaatgcatatttttgttggcactgcatcaaaattgacatcaccggaaataatgtatgtgtgtcgttgttaactgtacaaacaggtatcatttcctttttaggttcagaaattctctctgtaggctaatcttttcaatcgaatgctttgccttcagacgtcaatggaatgagctaagaaatgttatagtcaatgatttttgcatcattaaaagtagcacttagggctggaaagactttctgcaatgtttctgtgcagtctgtgaggatttaaagtagtttttcattcttagattttcttcaatttgacccgctgttgcaaactcccctgggaccacatggagggcccttccattcagtgctttacggtaatggtttcagagtttggtgttagcttttgctttgctgaaacttttcacagctgacttgataccagcactgaggcctgacctctcgatccttcagcacttcagaggttaattttgttgggggatcggatttctttcctggcctggggaatggtgatccctgctagctagtcctttagttacagagttgctgggtgcctgggattccctggcccagtgtgggctggctcagctggctaaaggacttgccatcctgtgagattcattcagcttctttgtccgctgttctccaagggccgcaatgtagtgaaatgctctggcctaggaaccttacaaggtaggacgattttctaaaatttctggggccagggggtgggtgtggtgcatgtactgccttgtcttccttggccggtattgaaaagcctggtggagcagcctgtggtgcagctgcctaaatcactgtgagctatgtggtggtgtgtgagtgggggtgggagggggcggggggcaaggttgctggtcaggaaattcacctcttctcctcttccgcccccattgattctaaccttgatggtttcagaggaaactggggcattacccgaatgtcctgggtccacctagacatttgggtaatgtcaatattttccaaaccgtcttatcaaattaggctactgagcccgaaaatctgggtattgatcacctagctgtcttaagtcgttattccggacttttcagctggtgggggcagtacagaggggtgagccggaaaaaggcagtgtggccccaggcaagggctgcttgtggttcagagggccctgattaaaaagacttgcagttggaggttttgtttggaatttaaggatcctggtgaacttgtggttgtgtttatacagcaaattgctgggtgtgtgtgtgtgtgtgtgtgtgtgtgtgtgtgtgtaaactaggctccaggagagatggcatgggaggtttaagcataaggacttttcttgctaccttatgacctatagagctgcccagggaagcacatttctgtttttaagccagacaaggggagaagaaaacaatgttcatgaccacctaccacatgccaagcatctagcagacattgtgtcattcaatttcattgcaaagccagggagattacattcaattttgaaaatcaccagtgggaaccaagagaggttaaataacttgattaaggttacacagctgataagaggcaaagctgggattggaacccaggttcactctaccaccatgccttcctgggtgggcttggcatctgagctcggaatggttttacctgttaattttaaatgtgacttcagctggatgaagggcgtactttgttgtggaggactcaccgaaatacacaggatgctagcagcacagcctgcctgggcttctcggattcagcttgtttctggaaggaagagggctgtgtattaagaagcagccctgctttggcagtaggacctagctgggagttctgtgatcttgaggctccggggctgctggattgatcaggctggagctttagtttgtacctggttcaggaagacttgatcccaagtgaaggtcaaatcaggaaaggccagtgaccttggagctggccttgggctgctgaggctgtgccctggaactctgggtctgcttcttaagacgctgaatgtatggagtcttggagggagaagatctacacccagcatattaatgctgaccaaagctattggcgctagctgttcacatgtgtgctggaggtgcctaattagctaaagctgagcttctcttgggctgtagaaatcttgacctgaggtcccttcgctttcctcttaccccaagaaagagagagcttaagggcaagtccttgacaaactgcaaaatgaggccagcctgtttttgggagatagccgcctcccttggctgccctggggcaactgtggttctgttttgtgcattcaggttcccacatccctaagatatattgggagcttagtggagggttggagggagggagactatgggggtattgaactcctgtcccattctacttagttttaagacagctggccaatgccctgtctgggatttgtcccccatcccctttcctttaatttctttgagatgttttaaaagtaacttgattgcattaaagtgtcctgtgtattttgaataacagttggaagttctgagttcttatatgaccatgatctatttagatgcatctttacctctgttcttaacattgagtcaatgtgattttaaaaagcttgggtttcagaatcaggcagatctgtattcaaatccagctctgtttgttagccctggcaccttgggcaggtcacatagcctctctaagcttcagtttccacatctatccaaagggggcattagtagtttgtgcctgataagaaagtggagaggtgtttatgggatggtgcttagcatggtacctggaacctattattaaaacttttcaccttgtataaatgtttactgttattttcatttgctataatatgctgaactctgttgatgtttaggggaaatatatcttctggtaaacagaaaactaggatgagtttgttgatatccttggcaaaagccagccagcagtggcccaagggtaagcagccctctccagaggagccttgaaggagagagggctttgtgtagctgaggtcagcagacacgctggtgcctagtgtaacaatgagggtctaaggcatccggagctttggtctgggctttctaacgcgaccaagctcctgaagccaaagggaaaaatttcatgcttactcaggggaccacctacttgtcaaggaatgagttaccaaaatgggacaaaggtgcggtggggtgaaactcaagcctgatggctgctaaatccccttggagccttttttatgcggtttgtgttttcctctctccacctcaaatcactggccttgcacctggcaccgtctgtagacgttgcttctcccctaggacactatccatttatggcagtaagaagcaagttcttacactagaacttaatcatctgtttgagaatgtaggcctgcatctccttcctgcagtccttgcagcttccctggatcctgtactgcaactgacatgcatggactctctcccatatacatggagagctgtacttaggctacctgatttggtcccaccaaaatgattatgctaactggatgttattagaacagtgccacccaggaggtaaaggtgccctgataaggagatggcagagccagaattcaaacacagacctattttcattttttctgcagagctgtggtctctccatttggagcctcctggtattagtggtactagatgagactaaatttgctggggttagtgactacattctgtccttgcattaattccagtttaggctctggatcatcttgcaccagaactgcaaactatgtaagctggtcccagagctgtagtccagagacaggtggcttgcttatagtttttttttaaatttattttttatttttattttttttgagacagagtctcactctgtcacccaggctggagttcagtgatgcaatctcgtctcaccgcaagctctgcctcccaggttcacgccattctcctgtctcagcctcccgagtagctaggactacaggtgcctgccaccatacctggctaattttttgtatttttagtagagaaggggtttcactgtgttagccaggatggtctcgatctcctgacctcgtgatccacccgcctcggcctcccaaagtgccgggattacaggcgtgagccatcgtgcctggccagcttgcttatagttttaattaaagtaactgtatcttctttggtgtgggaaactttgaagtccttcaaagtctaatgaacacatgacgagcgttcattaaaatgtgtaaaatgaatagataaatgcgatggttgaacactcatgtgtctgtgtttaaatctcagcctcaacatttcttagttgtatgacccgtgggactatttctccaatcctcaattgcctcatctgtaaaatgggtatagtgttaatatttatctaacagtaactgggagaacatatgttacataacaacagagcctgacacatagcaaaccattaataagtgttggtgattatttttatcagagtttggaggattaactgaaataatgtatgtagtgcagttagcacaggggctgacaactgtaaatgtcgattaaagttggctattattatgctttccacatagactacaaaaggtaggactctgcaggagccctgcttcattctttgaaggtggattttcttaacaggccccagcaatagttagaggagatgatgctcccgagaaaacctcctggggaggaaatagttaacatacctgtttggtgggaaatgtaggtagccaaaccctttctcttccccaggggttactactaagcctacagttaggcttgctcactcatccacaccaaaggatctcgttccgctcgggccccggggtttcacgggaacaattgccttgaacaatagccagaaaacgagttccaccagtctggacttttttgcaactgaatgcagctgtctggcggggggcatgggccagccctgtaaatgggctgtgccttgattctggagcagaactggaaaattgagcaggtaagtcctggatgcagctggtcacagctgcgcagtgtgagcttagtcacctggaaagaggcagacagaggggcgggggctggcccagactgtttccaaggacagtaagggcctcctggaagcagacccagcctttggagtttggggaggattaggatccttgctttgtgaagactgcttttcagaaccgtagttagagaacctcatctctgctcaccggctgtggttttattagtaagtagagaggaactaatatatatctacaatctgattttttttacagcatcgtttagcatgtctttcccttgaataaacaacattatctcacagggagttcatttgaaaggtgtaatgatcctccctccagatccttcaataactcctcctcccggagtcttttgctgaaagcaagggtgtgtatatcctagtggaaaaatctgtttaatcatccctggaaccttgggattctattttgcttttttgcttcatgagagatgaaattgtaaatatcatatcacattaattcaggaccattacagattcttgcttcttttagatacctctctggaagagcttgatattaaaaatttgcctatattaaatatagtttctcaggggtcccagtgaagtctggtttactttctcagttctgtggaattctcactcctcacaacagtggagcaaaatagatgtgtgaagctgacatgatttatgcttctttcacctgcattttttcatagcaaatcgcttgtcttggggttgttaaaattgtgctttaagccctctgagtggcatttggattcctgacacggtgatgtcagcatcccttctaagactgaaactggatctcctggtttaatgggcccttccatgtttgaatggattttctggtcacttttgtagaggcttttcccttcacatctgtatttctccaagaggtagtagagaaacagctgaggctgaggctgtgagagccttgattctggttaaaatgctacatgttggccaaaatggggtctgttcttgatacacttggtgactgctggtagatggaggttctttttgattaagctagttaacagatttcaaagctgatctgtatgtactatagctgtgcgctacaatctataagacactgccatctttcagatgagctggaaggctgcttgcagtcattctgccgtggtttgagtctcatccttctgatgagctctgcgtcctaagtctcctttccatccgggggaaaatgggggtggaataatataaataatgtgcctactacagtgcctggcatatttggtaacgctgtcagtggtggctttaagtattaggcaagattgcatcctctttctttggataaatagcatggtctggttcagacactctattgtgagttgagttgtaacgcctctataccagagtttgcaaactcaaattgcaggaccaagcaggtagcacatgtgaactgaaaggctcccatggggattgtatcaaataagagaacatacttctgtctaaaaagggccgctaactcagggctacctaaaaataatctgacaggtgaaatcagcaatgaaaaagcccagacattagaaaatggagttacctgttcggcagcttttactgaacgaggggagaccattcagtgtggagacctccagtgtgcccacttgcctttgtaccaacttttctctgagcataaatgtaaaggacgtccgttggaaaggaacctttgggatggcttagtccagctactccattataaagaagagaagactggggcctggagaggatgtgtcttgtctgaaccctcacgggtggtagttctgtggaagcctggagcaaaggcctggctctccttgctcctggctcttgctgtgtccatgtgttgaagaagaaagcagcatagctaaaagcgttggtgggcccgggctttggaactctgccagaagagctctttgtgctccaacttggctggtggctttaggagatatgggaggctatagaaatgatgtttggaaccagtgttgtttccacttggtgccctttgctcatctccctattttatgttttcatttgtgtctaagctatgttcttgtctgttatgtctactggatctatggtcaaggcagggaaaactctgaattctcactgtatccccaccgccttgcacagtgcctggcacacaggggcagtggctcaatggatgagatgaagaagtgaattcaaagcccttggctaagggtctaaaaatgtggagtttatgagaagaaacatagaaaatgtttcataaaattccttccacctatacattggctaaaaatatgtgaaggttattttaaaatctgatcacttataactccagttacgttcttatctgacttgaccaatgtagggcatttcattagtggagaaaaaggtacatagctgtgatctggttaggaaatcatgcttttgtgttgattgttctgatgaatcaatggaagtatcttctagccatttctctagatgtttcagccaaagaagtcaggtatatctgtgataggctgtcttaaaattattaaaaaaccaaaaagatagggaaaccagccaagctctgtgtcccatattcctgttagtttccaggaggaggccgtggggttgttttgcttatttcccaaggttgtcaaacacaatgctatctccagcaacattttcagagcaattttggagctgctttgaaagttttattgtgtagagtgaaggtgaactggagtggcaaaacctggtgaggagagaagatgccatcgtgggttcatttattcttctagtcattcatataaaaatcattgattcattcaaaagatgaaacctgctttaatactttaaaaaatatcttatttttaagagtgcttttgtgcccaaaaataacttcttagagttaactaggatttaatatttaatcgaagttttccgttttttatctagattttcttagaaatcacatctataaaacaagtattttgttcataaattaagatcattttcacttgttgtcaattagtactttattcaggcaacagattacacttacctacaaaattagtgctgtttgaaagcttggataattaaattttcttaaatattttagactgcatttgtaaatttaacatacctggtttccttaagctcttcagatgtctgacagggtagatttaccagccaaacaagcaaaatctttctaagcacttaagcaactcttgcaaatcaaataaattagagttacaaatgtcacaaattattttcataaagatttcaattctttttacaaccgtaatccaattcttaaacatttcagcttaaaagtctcaagtaaaaaatcaatagtcatttaaaattgaaatcagaagactgttttgtcagatcctgttatatgctgtgtattcttttaaatgttataaatacatactgattaacccaatgatcacaaagccttaatcttaatattatgatttacttcatcattctttttcatctttttaaacctttcccagatttaaaatcacacactctgaaataagggtagtcggtttatcatctcaggtgggctcagcgccatcatatggtttttctccgactgtttcaggaccaggacacaggaatggtccaatcctcttccaggaatgatggttccagaatcatagctgcgtacactgtagttctttctgctgtgttatcgaggtccccaagccacttctctggaatttcatttcaccacatagtaaacacgaattctctaggttcctttcaagttgctatcttaatcactttttgtaactgctttcaacatttattgcccgatttgggtcagtggacttttgtgcctcatcccaggttgtacctaatttcctttgtcacttgattagattcaaccagtgtccttactgcctgagtgaattctgcatgctttccacatttttcccatctgactctcaaccacatatctggagttattttacaaacaagttacgtttccccattagttagcatgagtatgccaagtgacaaaaagcaaaagaaaggaatttactatttctcatggctggatctcccaggggtgcttctggctttcagtatggctggatgtgggcactcaagcgatgtcaaaggcacacttccatccctctcagctctgcttcccactgtgccagcttccttctcagggaagtgagaatcaagtagccactggcagctctaggctctattgcatttttcttcattttcgctttgtgtgtgtgtgtgtgtgtgtgtgtgtgcttcattcttctcagcgtttcctgtgtagtcacataagtttggggaatgctcctttaggcaaagttatggtgatctttactggacttcacagctgttaaaatgttgatgtactgtttacagtgtgaatctccaacaaggcaggagattccacattcccttcttagggcaacattcttatcacagagcatctggtggaactggttttcctcagaatacatctgcaaactcactgaactaatcttggtggctcctgatcatttgtaccctgaatgggaaaaggacaagttagaactaagtgactttatgtcaagatgaacttgccagtatcccagagacccagaagcaaaggagacatggctggttttccagctgcaggggcagctttggtttctggccacagacagctctggcaaatatcgaggctgcccttgctcattgtggccttccctcgtgtcactgcccttcatccttgtcataagtgtcccccactcccacccatggattagatccctggcttcccctcttctgggtggctcagttacaaaggcttcctgtcaactcagggtaagcacgcagtgctccaggcactgatatgggaagaatcctgtgtatcaagggccacatgcccctccggaatattatgttggtgttgaaaggacatgggggaagaaaggttacaatttcaaagcacaaaatctgggacttggattcatgagcatctgttacaactgctctctttcctccctgccagccacggtcctctcccaccattcccctttcttcttcatcaaattatgagaaattttagatacattaaattcctaaccccaaagagcagatgcaagaaaagacacatgagattttcttttaatcactagaacaaatttgagtccttttccatctgtgacgccatgctttcccaatcagatcctcctgtggttaccagcctaggtgaaacaggcacagaagctgtgaccctgcaaagaatcattgggcagggagctgggcttagaatccactactggtggtgagtttgcagcagaaacttgctctatcttgcctctgcacattgagtttgtcaggaggtatttaaggagcacagactgtgtctttggagatggaaggcacgtggtccaccgaatgaacttgacattgctgcagcattgcccctcagtcctcacggcctcagtttcttcattatgaaacacccttaagagtgactaggagagtatgtgcaaatgttgaatagtttggcatgtggcacaggctcagggaacagccgttgttgctacagaaggcagcatgacacagactagaaggagcacatattttgcaattagacatttgctttttaaacccagttccaacactgaatgacatcggtcagcgtacttattctttcagcctctatttcttcatttgtaaaatgggcaggatgatacctaccttgcaggtatgatatgaggactggagaaacctataacaatatatttaaagtacccagcacaatgcctgatcatgataagcacttagttgttatcgctaagcaggcccctgcatatatttggacgataggacggccctttgtatagagaatagctagaaaactgtgtaagagtgtatagaagcaaatagaaatgtgtgacactatgtaggaatttaaagtaggagatgatgtgggtgggctggagtatttgaagaaagccttaaaggaagaatttggaacaggatggagggctgggcacaagaagtagaattacaggagtgaagtgtgcagagttccagagctgctggacccttgtggattcattcacaataagccccttttgagccctcactctccctgcctcatcctcccaccttgggaccaccctcacattcccctgcatttctgtgcgatgttccaggttgggttttggaagccaaatagtgttgaaggagaaggtgatgaaaacaggtttttagtaagcctttgtcttcctgcctgatcagcagagctcaagatgtacaggcaggtatcttccaagctgctggaatgaactagaactttggggttatgtgtgtgtgtggcagacgttctgttggctttcaaaatctcaaccactcagcatttcccaggttccacgctgccactttgtagggctttcagcaagactgtggaagactgagtggtagaataatgaggttaagtcaatgctttggtatcagacctgccactcctggctgagcggcctttaaccaggctgcctggcctcccaagcctggcgtcctcctgagaaagtgggctgtgtcacatctggtgtgtgctgagaattgacataatacaaaactgtctgcagtcacagtaaagagggtagttggttctggaatcagaatggctcgatcaagatccactctgtctcttcctagccctctgaccttgtacagggtatctatttttttctaagcctcactttctctgcctgtacaatagaaaaacaataatacccttttcccctataggtcaattagagtagtgtcacactgatcttggaattctgctttattgtctacgtgacttctcacttctgtaagtttcgatcagcaagttttttttttgtttttttttttttttttgtttgtttgtttgtttttgagacagagtcttactctgttgcccaggctggagtgcagtggtgtgatctcagctcactgcaacctctgcctcccgggttcaagcaatcatcctgcctcagcttcccaagtagctgggattataggcatgtgccaccacccccggctaatttttgtgtacttttagtagagatggggtttcaccatgttggccaggctggtctcgaactcctgacctcaggtgatccacccgccttggcttcccaaagtgctgggattacaggcatgagccactgtgcccagccctcgattagcaagtatttattgagcacttgctacatatctgctacaccacagcaaacaaatgagtaaatgcaacagggtgacgtgacagagtgtgacaggcttgatggctggtggggtggttttcctgagaaggtaactcttcagctgagatctgaaagatgagaggaggcaggggcaagtgttcagaaagagggacaagcaacagaaagcctcaaagagagcaatcttggcttagaaggaacagaagtgcatgtgatcagagccactcgcaatggagaggggtgcaaaacaggactggggtaggaggcaagctcagagggtcttgaggggccatatagagagtttggactcttaattacctgagaaacaactcaagggtattaagcagtaaagtgacaggatattctgactgctgcgggcggatggaccattagggagcagaagcagaccacagagaccagctggccttttagcagtaatccaggcagcattgaccgcaccatgaactgcagggtggcagtgggggcagagaactgcacatttggatatgttttggaagcaaggtgataggactgggtgctggattaaacgtggtggtggtattggcaggtggggagatggtacaaaagaaaaaagaaagaaagaaccattgctaggagactggacttaggcagcttgggactgacctcattcggttggagggttgggaaatgaagaacatctattttagatgtatttggggatattattagagttagagctgctaaccaagttgacaggtttctcctaactgttgccgctctccctcgctcggcgtttcattccaggagtgaagtctgcagaagtcatacagcagctctgccctctgacccgacaggtgcctgctgcggagtccttccctgcatgcttttagctctagtccccagactcactgcccctactctgccactaggcctgggaaggaacaaattggtttccataaaattctcaggatgaagttgagaatggggtaggacatgggtagtgtctgtagccacccctgctatggaagcacttagtttggggaaggtatctgtcagcctcttcacccagcttccaatcccagacagcaatgattgatgtggagatgagtcacatctgagtcaagagagctttgtccggggcttcatggcacagattggatcttttcggggatggtgtttgtctgtctgtgtcatcagcctgagctggaacagcctgaggttttggtgctcaggatgtgtgtttgtcttggcagctgggacgacagcagctccgtcagcagcggcatcagcgacaccatagacaacctcagcactgatgacatcaacaccagctcctccatcagctcttatgccaacacacctgcctcctctcgaaaaaacctggatgtgcaggtgaggaacacaggccctcccaggctcctccagcagcctctggcagcagggaaccttgggcttgtggggtaagagggccatttggggcaaccagaatctccaggttgatgagatgaggcccagcctcctgccgcctctgctctcacctcctgaccctgacctgtgtccacaagggaggggtcaggcagcggatggtggacacgggagtagggaggcttcaccaccctcactgtgtggacttgatgaaatcactcttcctccctggacctcggtttcataatttgtttaaaaacaaacaacagaaaaggatgtgggactttagcaattttcagcccagagtgtgtgtctcttatttgccgcagcaagccactgctatccaggggcacgtgtctaatccctgtaggaggatggggtggaaataaagattgagaaccctggaccggaaggccgggatgtcctgacctgtggttgagaactctgtctctgggttacattcccctgctgacgtgttttatttggcccacagtgttacccttcttttaaactagattccctgtcaaatttttagaattatattatttcacatgaaaatgtcttcctggttgctcttgagaaaaacaaagatattgcttccttgagcctacattctccatgtggtgacaatcaacagatgtcccagtatccaaccccttagacctgccactcctgctccagtgtgcacagctgctaccctgctggccagctgtactccttaaattacctgcctgaccccaaggcactggagttttccattcctactttaaggcttcagatttcatgtttcaaatgtggtgtagtttcatgtggacacgttcactgaccctcagaccattccttcatgattggcaagggatggttctgaaaggcccattttactagtggaaacgtaaagtgctgtcctcacagcttgtccccagtttgggactgaccagcaccagaactggccagctgtggtggcattggcgtcgtaggctggaatctttttcatgattgatccctcccatttgcaggcgccacccctccccaccccccatctttggcgaacccttggagaaatctgtttgggacaaagtctctcagagcaaccttgcggggaggcagaactagcactgccccgtctttcactcccttccataacctcttcctttctcagcagtgctttacttcatacagataggagctgatttggaaatctattttcttttaaaggtatctcttctttgacaatagggctaaaaaaaaaaaaaaggatgtatcagagtgtgggagtaattctgtcccacagaaatggaaacgtttaatgcctgatgaaatacattaggtgttgcccctgggattcccagttacttcttgtattcttcatttgagccagactttctgattattgttcagaaacccaacctagtgacagtgggtggtggtagttgttttaagaaacaaaaactacccatatgactagaaagggggccatgggtaatgctctgtatgttaatctgagcagtggctatgtaagtatgttaattttctaaaatgtattcaagctatgtacttaagatttgtgtactttactgtacaaaaaccaaacaaacaaaacctaagccacacttcacaagccgatcactgtttcatcagtgattagacgcaagtcagaagtgcccagccaggctatgctcctgccaccaattttcctttccttgtgaacactaatttttttttcctgaggctcattgtatattcaagataagaacaaccagactgtccttagatactaaggaaggaaccaaggaattgctcaccctgcatctacatattcaggaggcaggctattagaggtactgcagagagagagagagagagatccatgaggtttccatttttgacttacaaggtaggagaagcttgctcctgagatgcaggtggagccagtaaaacactgtactggaagaatgtccttgcctttgttcccttcttgcaaagctggaattgaaatctctggttccacattgataaacaactcggatttgtacatgattttctagctgatacagtcgccccagctctttagaccagctctttgctttcatcttgtaaatgtcacatcagaaaaggctgcaggattctgcacaaacatgccttttgatcaagatcagaagttattttaagggatgtaaatggtttactactcattgggtaggttttttttcctataaaactacctgagtttaaaatgttgaaatgaaaactaaaaaaaaagtaggtcttaaagtaaactaaatgcagattacaccaatagttactaagatttctaacgcaatggtttctttaaatggatttttagtgacattccttttgttcctgtccagggagcatctcaaaatatttgaatcagcataattcacaggctcccatcctcctccctcatatcacgctgaggaatgctaagggccattactcctgtctgagcggcatcaggcaatgggaagatgtgcgttgtacccttcccaagagctgcgccttctatgctgtggctcatttgggttcctgtcacatactggtttaccctggaacaggtgggcagcacacagtctgccaggcaaggcgtggggaggcagggagaagtggctcagcatgtccatcaggaaagcaaattgaggacaggttgcctgcctaggtttttgctgtttgaaaagcctctgagaaataactaaagcatctcaggaacagggaagttattgtctggaaaacctaagaaacagcctcgtatagctgattgaaagaagaggagacggatcattgggaatggagattccttttgtctgtgagggactccgctatcactggggacattgaggagcaacggagaatgccccccacagagcacaggtgcccagctgtccagcatcagctcctgtgcccactgtttcctcagggccaggcagagaatcccctgcttgaggcccaagagcctcttgagcaactcctccaggagagctggtgagtccggttggccaagcaaattgaggtgtcagggagtaggtgtggacctggaagccacatgatcttgagttgtgctcctcactctatgacatccttggatgaactaagcactctctccgagcccctgcctcctcatccataacatggcactaattagatgcaccttcaagggtgagtgtgaaagtaacagggaaatgctttatcagcacatgcttccctaggtgcctgagactggatggttcctcagaagttactttctttccttcttccttccctccatttctcttatctctccctcccttcctccctcctctccttcccttcgtcccttcccagcccctgccacctgggttaactgttcctctgcctccagcctccattcatggcagttaactaaaggttgactacgttcttaatatattttgtttgtagtctcaaagcaactcatcttactttgcagtattttattttgaggacagatgttggtggcaaagggctttaacaaacacacgcaactccctcacatattcatctgtacattcagtattttctctcagttctgtggaaggcaccatcccaggtgctgaggagcaaagatgcacacatcaagatttcctctcattttcaatgcctgtgaaatgtttaataacatatgcggaggaaaaagataattccatgtcagtttattttttgctactcagggaaataaaattctgaattatgtggcaaggattcctgtcttgtgtggccttgagtgaccctagagctctctagatgttggcatggatgtagggatggggtttggctgggggtgaggaggggtgcccccttctgctcacccgctgggtaagttacttttcctcttcagccctgtattttcctgatgtgtaaaatgtggataataacacagcctgagaggataagatgagttcaggatgtatgtggagggacacagtgcctggcaggatgactggcaggcgatgatgttgatgcagataattatctccatggtcactggggcttaaacttgagccagctcagcatctagatccgcaagggatatggcacagggagggaatatccctgccttccaaaggcctgtggcccagtggcagaagagacaagtacctgttctcccataatgcaagacaaaggcaggataaatgctaaagatggacaacagagtgctggggattttcagaggcaggaaagttggtaatgaatagaaccactgtttattgagtccccccacactgagttcactgagttcaccatcaatgctgtaagagacctatttatcatccatgttttatacatgagttaataagttcagataagtagggcaatgtcttccaaggtcatgcacagcaaatgagtggcagcaccgaacacttgaacccagatctgtcagacccaaagcccacactcttcccccacatcatgctcctcaggcctcacctcttgctctcagaagactggcctcccttctgaagtcccttgtgcgtggcttctttcctcaccttcccatgtggatatcgaatgactacatagacttccaagaacaggcagaagaaaacccttcagaaaggaggtaccattgagatggaaacaactggccgaggcatggaggggaaggcaggatagaactcttcgtacgtccccatgtggatgtcctgttggctggttccgctgttgcgagctccaggaacagagaggctgggactttctcgttttttaatcccaaggggtgccaccttatagtccggcatgtagctcatgaaggattcagagtagagctgggaaggtgaccaccctggaccaagctagggagatgtgatggctggatgattgttctttccagagagagaaagtcaagccacattcccaggccaggggcatgtgcgctgtctctgccactgatggaaatggagttgtatgggtcccacctagaggctaagctagagctgctctagaactggggttggggagcctgccagtatggaaggagaatctgctgggtatagctattaggtgctactgagtatgcacaaatgtatcatatacctcgacttatccttagggagggcagtgtggcatggtggttaaaatgtgggctctgcagttagactccctgaattccctgcatctctacttcctcactatgtgatcttgggaaattttcttttcactgtttgcctcagttttgtcatgtaaaattgagactattaactgtaatttcctcataggtttttgataaggattaaatttaatgatacatatcaaacactttagcttagtgcctgggacgtagtaagtactcaataaattgtagttgttatgctactagtattagcaccattacagtttgattggggggaaataagtataggaacattaaaagaataaataatgcagtaacccaggatgtggcatgtgctaaattttcagtacctcttagagcatattagaatatgttaaaatgtacttgaatgtaagctccatgaggttaatgatttatacttgttcattgcagtattcctagtgcgaataagctttcctggcacgtagtggcacccaataaatatttgtgaagtgaatgttccaaagccaagttattttctgcctcaggacctttatacatgtggttccctctccctggtatgctctgccccaaactcttcttttactaagtaagtttcttttctttctttagggtacttctttttgaactgatcactgtcgcctacccacctcattgtcatctaaattaggtcaatgtctatatttatttctcagactttttgtctttttccttataatagtcttcgtagtctacaattacacccttgtttgtgtttatttattctatctctgcctgtttcactggatcgtaagctccaccatgggtgggaaatcagtcttatccccagattctctgaccctccgtggtgcctggcagacagcaagcatggagtaaattctggttggatgaatgtactggaagtgtttagaggaaggaaactgacctgaggtagttgggacaaagaatgggcaactttagtttctgtaagattgagataaagataacagtacttgagtacttgtgtacttaccctttctgattaaatagaggctgagatcggataagataattttgctaatgtctgttgtggcctgaaaagcgtgtgttccttggctccttcctaggctcattcattcgctcatcaagctttgagtgagctcctgccctgtgcccacatgtaggaactcccctctctctgtcccttgccacagctgaatgatgagcttctcatagccaggcagtgtgtgtttgtcctcctcatatctctagtgactaatacttagctggaaaaaaacaaatgaaagaactcataaggtgtctgtaatggatgagtggaattcataaggggagaaggggttggggtggtgttggggaggcgattgaacttgggctgcctatctgtttttagcttttatcccattcagccattgtattccatggaggaaggcatttcttccactcttggatgacaggcgttaggcagattcttgccaggtgttcattttaatttcctatcttgcctactctcggtagttaagcattgcaaatatgggactggtatcttagtatacccaccctgaaagcgctcctgacctcccttccccatttaccgtgctgcttctcgctactgacatcctccaactggcctcaaaccccaggaggcctccaaagcattctggtcagctttatgccttttagctgcaggagatcattaacgtcacacttcggtccccttctgggttttatggccagcaggtcagggctcttccaaagaaagctggctaattatatcccttgtcagaacaaaatcccacaaggggagcaaagcagtggcatataaataatgctggggtcggagcaggcatcattggctctccgcatttgggggaagtagcatttgaggatgcgcttcccctcagctcctggctctccctgatttgcgtagaaccagcagccacccttgctcccttgcttggtgtgttagatccaaagatctctctgcggtgcagtgatgggaagaaggcagaacaaagggaaacgggccaggagactggatgctggttagagatcagccgccagagttggaggaggcttgttcaagtggcagaaaataggtggtggctgaattcccactgcatctccatctgctctgccccttcccctcgctagggctctttccttcttttttcctgggccccttttcctctcttccctcactcctttcttttgcttttcttttcttcttttttgagacagtctcgccctgtcatccaggctagagtacagtggtgcggtcacggcttactgcagcctccacctccccggggtgatcctcccacctcaaccacccgagtgggtagaactataggcgtgtgccaccacactcagctaatttttctattttttgtagagatggggttttgccatgatgcccaggctggtcttaaacttgtgggatcaagtgatcctcccgcctcagcctcctaaaatattaggattataggcgtgagccactgtgcccagccatctcgttccattccattccagggatacattgatattatttacttttttatttttttttccaaaaaaaaaaaatcagtctttctaacaagataaccagagtacaaaagtccaaacatctttaaagtaatgcttatttttcccttaactactccagtgttttggcatttttgcctttggagtgaggggcttcccagcctgggactggggaaggactaattcagagagtctctgtccacagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggtaagaggccggggctgtcttggccctacagttgacattttgaaaaccaaagccatagttaactctagcaaggacttgacattatatattttgtctcaggatttatactctgctaacaacgagcttccataaactttcacatccctacctttttctaagtggaaataagtaagcatgggagcctcttaagctctgaagatggttcggctgctgagacatactgaattggtttaactagacactgggtgagttaatgcagccagttcaggctattcaacagcatgggtttatgagctgtgggtgtatggtgagttgatgttgtccctgacttagggaatatttataaacaagggcagaggtatcccctggacatgttagggacagcgctttaatggacagagggtgaaagatcaggaaaggcagggggttctttccccccagacatatcagtgattggctggctttgctttatcctgggtaaatttagactgctttgcaaatgagtaaaattattgacatttcctaaaaggctcacggtacattagtagactatattatttttataaaaagctctttcctctgcctccccaagggaaaagtgaaccagctcttcagaggaggagagcatcttaaacagacgagatggatgagctggctcttggcttgcaggctaatcttgctgatctctctcttaggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcaggtaagtgagtacataaatggtgcagagcagaaccagaatacagggaatggatttagtaatttcctgtttcttagttgaagcaccctctgtttttctccactttagtcctccagtaaagctgttttgtcagatcaggccggcagttttgcagttgactattttcccatgttgggatgaaaaacttaggcctctggaatcaatcatcttagaatcaaatcttaggtccattttaattagctgccatataaccttttttaacaattctgccttagtttcctcacctgtaaaatggggatgaagatacttttttgtcagggtttttgtaaagatacatctttgtagctgtgtctggtcgtagtatgcactcaatagaagttagctactgctgggcaccgtggctcacgcctgtaatcccagcactttgggaggccaaggcgggcagatcacgaggtcaggagttcgagaccagcctggccaatatggtgaaaccccgtctctactaaaaatacaaaaaaattagcctggcatggtggtatgcacctgtagtcccagctactcaggaagctgaggcagaagaatcacttgaacccaggaggcggaggttgcagtgagccaagatcacaccactgcactccagcctgggcaacagagcgagactccatctcaaaaaaaaaaaaaaaagaagttagctaccatccaatccagaatgaggtcttgatacacccttggacctaggtgggtagctcaggggagcagatacatttttttcttgtgttaataattcttcagctgagcttcctcattatggcaggcagtgatcttgaccagctccttcctttactcaaaaagcccagtgtccccacatatacttttacgctactccggaattccaagtcagtctgaaattttaacttccccctccccatcacacacacacacacacacacacacacaaacctcttaaagaagaaatatttctgaaaaagagaagttgatttcctgttaccttaaatagacatcatttccccacattttcacactgggtggaagctctagatataaacaaattattcacttgtttaaagtttcttttaaatttattcagcttttgcctgttcgtattatcttattataatatccactggaccattctcaaactgcaactgctaggttacagttcatcctactttcccaggaaatttcttatcataagaaagaataagtcccaagaaaagaaaatcaagcagtgagaaaataaaaattatatgcacatgtacatatctggggatgaacaggaatgtttgaaaagacttcagaagaagcattccacatgaaaggtataatgaagcagttcactgttctttgtccagacttgattattagaatttcagtaacgatttttttttccaggggtaagtctgttgtgctgctctttgttgttttaacagattgccttgtaaatgaaaatgttctctgtttcttgcctcaagtattatatgtaatattcactctttggtattatagatttcctttactaactacaaaggcattttactagacccttaggctagtgtaatggaatgcttgaaaatgcatgcagctcctacggctctacattgaacaccttttagccaattcctggtaaattacatttcttcctaaatcgttaaggtattcttagttctcttgatgtgtattagtatggtgaagaaaaatctttggtgaatttgatagataactctcttcaaatgatttcaaggactaacagaccaaagattagacttttgtatgtagtcatgcatagcagaatgaggagcaatatgcaaaagtcagaaaaaaaagtggatgagatttgggtttcctaataattggaagtgcttggcaatggaacaagttaccctttgaagtaacgaggtccctgtcatcactggaagtatgtaagcattctaaagccaagattctacattaggatatttcattccctgttgtcaccaggcacaaagtgtttcctttctgccaccacccactgtagtaaggattgattgattgattgtctttacaatacttgagatttataggactgtctagagagggcagagatcaaactgtcacgactttgagcacccaaggccacctgcatgtcagaaatacatagtagttttgtcacttgtgagatacttactcaacacaggtttcagtgagtgtaatagagcctttgcattactagaatgtggacaattctctgacttaaagataatttcaacattctaccagagagttctctgccagtggaagagggggcatttatgtcattccttgtagtctgatggcacatttttggccacgagcaggggagatgacatagaatagcatttctgtgtgtctgtcacagagacacagttcccacccagtgtgtctggtctaatgtcttgtgaaccaagcaagatttccatgtatgtcactggataagtaagctctctggcttcaaaagatacatctttccagttgcgttttctattgtggataaatctctgaagacatttttcctaggccccctccagatctaaattcatgctcttgattctatgtattgtgctcagaggtcaagaaaccaaatcccttagagttgagctgtcataaactgtgtgcctgctttatgcctggggccgcagagacagagatgatgaagacaaccatcttcctgggccagggcagttttctagttagtctatctattgaaagaaagggaagcaagatcttggcccagtgtcatgtgaataggcctgtagaaaattattactcatggctctttggctcagatggagtcagagtctcagctgcagcttagaatttgaagacggcagcctgtgatgcactagtgtctaggcccactttatggctgacctttccctgaagtaccgttagccatttcagtaggaatggctgtgcttccttccccaggaattctcaccaactcctctgccctacccttctttaacagtccggtgccccttggcactgggtgttcaacctacacaaccctttgtctcttcacagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaaggttggtgctgtgcctctggctgcctttctcagaaagacacccttccaaaaataaaaagattagcttaggaatcccaaatgtcgaatagcctttgcctgtaagatttctctctttctaattactgctgtctttcatggggaagccacttcaggatggaatcaagcttggctctgctccctgttatcttttcctctgtggttatttttggtgcttggagctgctcagtctctcgggggcagatttatgctaccatttgaaatggcattcagcttttgaaatccttcagttttatcctgtttgttcatcaacagcttcttttccctccccttgtaattgtgcaagcagagcaggtgactgggtgcagacatggagtgtttagtaggatgctctttagacagctgggtaggtttgttgtcattgtggcaaacaccctcctcctggactgataggaaatcaagaaattaaaagtgttctcagagccctggatttctctgcagcagggataaatgtgtccagtttctgcatatagggaagaaagcgaggatcagcatggggaatgaaaaaaatgtatataacaacacctctcctttcttccaagctaacgttccttctcttgttttctacctgcctggacttctagccctctctcttcccctgctgctagccctaagttctgcagaagtactctgcccaggaaacaggacaggtaatgacattgcaggccggggaccaaccgagcctctaggttcttctgcccattcgttgtcaagccagatgtcttgtgcgaggctgttggcctaagccacctgcttgtgtttgtggctctagtgtactctgtgacacatggacatgccagtgagagtctgttcctctgtctgctaaagcccagggagaggtggagttgggctggcctcttcattcccattttgggaaggcgaccttaaaccctgccacttgatctggggcagcggaagctctcgcttgcatctcttgtggcctcctgtggcatgttcctgcttttcagcttccttcccattccttttgccacccccaaccccaagcccagaaatgacctgccacccactgtgtagcttggccctcacctttgtctacccctccccatgcagctgcctcttctccctttcaaaatcctttgctgaagtttggctcattatgtcttgcagactgttgtgttctgtgtgcccatttcctgcgatgataatgaaaaagaatgtgtagagtattaagactttacaaatgtacacgcttgtgtttgcccccagctgtaggtgggcctcagagatggatactgtccttaattttgtgggggagtgatgacctggccaaacataacaaacagatgttgtctcctgccagaaaaaaaaaaaaaaaaaaaccttcaccccatcaacagtgaaaactttgtttttgtcagctcacaaaccaagcctttaaaccgttggtctttagaaatccaagtgctttgacttcatcagccagcaagttgtaacatgccccacccaggactcagctcctagctatgcctgggccgcagaaattgagagggacctggaattcacttcgttacagatgaattccaaatatgcagactgctggcctcttgaaacctccaacaagtctgttctcccatttgaagtcattgccagtggcatttagggggtgggccagagttaggggtgcagggaagtgggcatccctctctctgagaagccgtgttggtgcagagagtgcccctgggcagtagaaggcacaggacctctgctttgaggtggagcaacccctgaattttgctttgaatctgtggaaaacgaggaacaattggggttaagggactcaggcctcctggtgacctggggtaaagtatgcgctggtgtcagctcaggctgaggattgggtttcttttgttttccacggatgtggatgtgttgcattgcacgcctagctggataaggcacttcctggtgatgtgcacctctttctccagggcccttcagtcccctccctagctttccctctctctgccttctgtgtgctgctctgaagttcttatttttgttttaactttcctacagtgacccgcaccttgataggaacactttgcctaagaaaggactcaggtatctgtgtttcctccttgcatctgtgccatctgttgtggctttggagcttggctgtgtgactccttcatggctggtgggggtttgggctgggctggggtccccgctttgaccaccacagcaggaccttttggatgacggctccccttgcaccctctcgttctcactctccatttgtcagcttatttgcttgagcaggggctgtgctttttcaggcttaatgtggtaaaaccatctcatgaaaaacatccctgggcaagcccaaggagcagtcattactgcttctggggccaatgggtttaatttctgagcacttcaccatgaccattctgttaacatggctgtcttccaagagaaaggacatgacttatagcatactgatttgtaagctaggacaagagcacaggaggcaaggaatattttcccccaatttgaaaatatttaacttttctgcccataaaaaattgctagacagatactttgcccttgtctaaatattctaatggaaaattggtccactttcattgcccaacaagacatgggtgtgatcattttttggtggataataaagaaaagactcccaggaaggactgtccttccattcctggtaagtggtggctcaggttcgtttttggtgctagtcctggcaaaacaagatgctataagtcaccattgctcacaccatctatatcactttgccaatcagagaaaattcagtttgctaatgcctcccctgtgatcttgctgtcttatggttgcagccgtcatttcttctgctttctaaacaccacatgccctgtagcatcagcttcaccctgcactaagcattaagtgctttcgcataaaatgggacttggaatgaaatgtttcattgctgtcatgtatgtctatagttaataacctgcagctcttaagactgagagcattttgaacagtaatgtgaggtaggtatcaatgcttcctttcaatgggatcctctgagtaaagccagttctaagaatctaagaaggaaagtattaaaatctcccaacagtcatcctgcaggaagttgttgagcagtgtggccttagagggggccttggcaaggccttttgtacttaccagtttcaatcgtgcctatgagctgcttgtcagcaaccatgccagatgcttaaatcatggccactctcactgtgagtttgactttgatgccccactggtgccctgagagaaagctaacttctaaatgttaacattgtgaaatggtgtgtatacttctgtagcagatctagcctatcaaaattatgtagctctggttttttaaaaattcagaatagagatacatgacaggctattttcaggcaattgatgtgtcctggaaagttgcatgtctgtcagatatagtaaaaacattaaggagaaaacatttctgtgctccctctcactctgattcttcctgtgtagctcacccactccatacacatgaacatccagtacgaacacactgacaacatctttccttaagcccaaagaatccccctattgacataatcagtagtcactccataatatataagtccgaggataccctggccacttggcactcagaaatttcagatgcaggccaggtgcggtggctcatgcctgtaatcctagcactttgggaggctgaggtaggtggatcacttgagggcgggagttcaagaccagcctggccaacatggtaaaaccctgtctctactaaaaatacaaaaaattagctgggcatggtggcacatgcctatagtcccagctactcgggaggctgaggtgggagaatcacttgaacccaagagacagtggttgcagtgagccgagatcatgccacctttctccggcctgggcagtagagcaagactacgtctcgaaaaaaaaaaaaaaaaaaaaaaaaaggaaagaaatttcacacgctacttatgggcataatgaaaagaacatgcattttaaaatcaaacatggattgaaatctcaactctgtgactaccagcagggttcttaccttccctgaatgtaaaataggaataatggcatctgcattgctgagtaggtctgaggctttggtaagataatgcacatgaaggcacctagcacattgcagatgttcaataaatcatcaccatatacatttcagaataaatgaggtggtggaccacataacttctgaagaccctctcctataaaactcaacaatttggggttgcttttatgaagatttgtttgtgctctattacagcaactactataagcatcagtgtcctcaaaccttgctttgtatgtctgctttttcatatgctgtgattcatggtcatttatttgtgttgtagaatggcagatgccatgagttgtctaattaaaactccctcaaagctctaacagcagctcattttgttgcttcagtcctgtcaaggtgggggctttgacgtgacactgtcatgaagcaacatgttacagatacgcccagtgacggctcttctgagcatttaccaatcttcttccctttatgtgttccctccaaactgaaagggagtagtcattttccccaaacacagccaaatagaaaaaaggttttgagaaacttcataagtttcaggacgtgtagtgatctgattttaaaaaaaatcatcttcggatatatgttttctttttatatatttaccatcagctccacagagttcattttaataagcattgttcatagttaattccggcttgatttctgtctgtccaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttggtgagtagccacttgtcattacctatgttgatcagctccacagggcagtggttatcttatatacataacatatttttatttcaatagtttttggggagcaggtggttttggttacatgggtaagttctttagtggtgatttctgagattttggtgcacccatcacttgagttatcttacattttgaaatagacatatagtcacatcccgctcagtgtctgattagccctcggcaatatagatcgattacaggggattgacagaaaaataaatagagaaaatagtaaagtttttgatactgtaatcaataattttctttatttggttgatattggtagggctatagcaaagaacatgttatcccattcttaaaaagaatgcattctttttctaagacctctgaagaaatagattttatcgcatatcccatgttaggtcatcctcattgctttattaagttggaaataaaagttaagttttgattgaataggtattcttaacaatgcctacttctgacataatgctttgactggcacagtggggaaaggaaaagaatttgtgtcacagtccctgctgacatgtcaatggaattctttttcaggaagacaaacacatcaatgcacacctatataatagagtaaaagagaacaatccagagctttatatgaaatcatgtaaaagctgaatataattagatagcaagcattagacacatttagaaaaaggaaagattagtgctggctgaagttataggcagaggttatgtgaaggtggcagagtaggagctgagccttgaaggactgatagagggtgagaaatcttttctaatctcatctcactctttagagaggcaggcttttctgaatatagtgaataacaaattcagagtctttaaggatagaggtggcttgtaatcaagtgaggtttaacacttcatttctgattgactaaatgagtacctctgaaaatattgcacatgactcaaatggacaggattttcataagaaagctagttttagctgagacaaatgtaccttccttgcattgaaactctttatataccattattaaatgtcccccatctgaggcaatgggatctgtgttcatactgttctttcccagccataactctttgaggcaagagattcttgtcatgcacaaatgcttcccatctgatcaaaagcctgattggactattttgggcttttggctttagagaaaatcattccagatgagcctggggagtaattagctcatgcctggaaggtgatactggcctgtctgaacgtgccaagttggaaagctgaggcccagagccttgctttggagctgacctgcctttttactcttatttttagctcccggtgtgtaactcaaatgctgatgggactaccttttagaaaacagatgggagaagagttggcagaaacacatgtggctaaaaataagcagtcttctctttgtccccaaccaggatttgaacagagacatgaatgtctaaccttttgattctattccttttattccagcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaaggtaaggaaggaaaggaagaaggtaaggaaggaaacttccatctcccaggttactcagtgtagttaagggtcctctatgctaagttcacttccttaacctgagagcccacctataagtgctcccacctctcccacctactctgggggtcaggggtggggatctctgaagagtaaggtctggcctgacccttaattaaccttccaggcctttgaggaagaggctgcttaaaaatcactggtgaaccatagagctgactgaggtccgctttaggcttctccctcctggacttgggccacagcttcttggcatgcgcctccaccttgaggctcagccaccggctcaccatcttggcagagagaactactggagagttcatttccctgtgctgacatgcccctgtagctctgggggccgggcagccacgcctttctgctctgctccagaatttttcatctcctttctcaagcactgggtttttaagtgtattgttttcagttatgcccttttctttctttggttgctaactgagaatatttggggttggatttttatgtttggttcattttaatcagaatcatgggagaaaagttctgtggacaactttgtcagccgtcttcacagctcacttcatttctctcttcctttgttccatcacgcaaggtatgagttaggtgagtaagcagtcaaaattctgtggaggatatcatccccaccccatgaagatggggctgatgggacattggcggcaatgctcattaaccaatgataagaataggagtcagactagcagagtttaaattccagctccactgctttttaggtatatgattttgatcaagttgcttcacctctctgtgcctctgttttttcatggataaaataggagtaataatagtattcagctcatggaattatgagaattaaatgagataatacatataaatgttaacacaataatgttattacatgtcatggcctgtaataacacagccgtaaagctctaataacatagctgtaaaaacacagcttcagcattgacttcctggcagctcaaagtccccagccagagagtggggaatcttggagcaaacggagcctagtctgaggactatacatctggttgtccctttgttgccattgaaaaagcagaatgtggagggtgagttataggtgcttcccggtccccatatgagtagggaaaaagggccagcatcctcccagcatgaaagaacaaacaaatttgtgattgtttaggaagtttcaagtcaaaagggagagaaacacaaggcacaggattctgcttttgcctagtgttctttttaacagaagttttaaagaatgtatttacagagcaattgccccctggtttattttcttggtaacttaatactttgcaccctgatttatgtatcatttgcataccatgacattcagtgaacaggcacaagtctgtaaatccatatatgggaagctgctgggaccaaggattaaggaggggagaagcctgagtcactgaggggcatttgtgagatttaagagctagaaattaatgctataactgctcagaacagtgatagtagagaatatattgtgatcctaaggtgaaggaagtggcagtttgtcttgaacttctttctagtcagtgtactggccaagcatcgccacagagcatttcccaacctccccgggaaggatttgcatatggagtttgtcccgcactgtattcctcttctctgccatgtgtcttcctgagtgaaccacgtccagtactgaaacttgtccaaacaagcacacttcgcctcataaaggtccaggaccattacagtatcgtcatcagatagcttttatttattccatctggaatcaagctggcagacagcacaactgtggaatatctgggatgtcaaaatgacattgataaaaagtgcttgcccacaagcagtgtctagacttttgtaaacctaatgattcatggtgacatggaactgaagcacagaggtaaaagtcaaactttaggggaatggatagggaccgctgtcaatacactgtgaatacataacattatcatcttttggaaaatatggcatcagattgattttatttcttctaaggttattacattcaaaaataaaatagagtttgtgtaattaggtttttaattcctttcgttgaaattcctttttttgaatttattaactcccagtattgcaggagcagttggaagaaaattgacatttcatgtttggaccaaacagaacctccttgtaataatcagttaggtgtattatacgccataaagcagaatagaaatttaggaagaagtagcacaagtatttgtgtgaggtttttgtgcaatttaattagctctttccactttgaaggagttttaggaattataaatatgtagattaggtacaggcatggccagatgcagcctttcaaaggtgtttcaggtaaattactttctatcagatgcattatgcgatcttaaagtcaactttaatagcgtacatttaaggggatgcttgaagcattattaaaatggattctagagaaaaaaaaatcccatgacttcaccaatcatcactaagagctaatgcagtgaaaaacacagaaaccctccaccctatcaatttatatggaatccccaggagcacagaagcttattaatcaagaaagcttgtattgcagcatgcttgtgtatctaggccctgaattgctgaagtggttcaaatcctggcacctctactgttagcagtgtgattctgagaaaggacttgacctgctcagcctgtttcctattcactgaaatgtgaaaaataattgtacctgctttggaaaattgaagtgaagattaggtgagatgaatcttggaaagcatttaacaaataactttgaaaggggagtattgtaagtgctcactcaatggtagctattgttataattgtcatattatagccttctccccaagggccattatcatcctcatttttttaatggccaaattgaggcaaaagtgacttgaagactttatgcagccacaatgatgtcttaagcttcttgattccagtccctctttcttttcactcaatcctaccttgatatctgactcagttgggttttttttttttaaacctgtctgaggcaagctctgatctttcatcaatgtcttctctgttttgtgatgcttcctttgctggtggagaggcagggcagtccattagccatcagcactgcatttcattcttctgactctttccacagtacccaattgtggaatgagaagtagatcgtgatgcctagatccacattctctttctgctcctgactagctgtgtgtctggccacgtcacttaaccattctgagatgtaatgtactctgttgttgattaacggtggaaactcctgcctagtctgggattgttacctgcagattctctgtgatgagggtcagaggcacttgattgctttattggctggaatatgcctagttgtttcattctatctagtgttttcactcctactaaagcatctttcttctcaaacattcctaggttgtgcccatgtgttgactgaatgaagggactaggacaccattctaaaagacaccaaaaggctctttaaaaaaaaacaaacaaatgaaaaaagaatcagaaaccagtacaacagattactcaaaggcagagcgatctccggacttctagtcagcagatcctgttcttgaattgctgtgtgaccttaaacaagtcatttcacctctccgagtttcagatttctcaatggcagaagtggcctagatattctctatggttccttgtagctgaaaaaatgtgaggtatagctatagggaggaaaaatatgtagcctgctttagctgtttagcttctgtaactcccacaggcattttgttgtccaaaaataaccacattgcacaacctaggctctgacctggctcaattcccttgaaggaggccgaactgcaatggttcaggtaaaacacattcagttttgggttgactcagaaaatcaaggatctgtctctttggaacacagccttgctgttgctatttacaaagtgagaggagttaattattgagaaaaataattacctctaccttaagcctgccagatgtgctcttctctgcctgtggccccatgcttgtaccgagttgttgctaaaactgtgtcagtaaatgtatgtatatgagatgtagaaatagaaaagaaaaaacttccattttccattagccacaggccatatagcagccctgtgctagtctctggcaggccagtcatgcaagtgtgtgtggctatgtgttacacacatctcttcacccagcttggcctccaacataattcctccactattgtctgtgtcgtaagctgaattaacttacctctgtggaacattaggccacaaagttgggacattaaaggcctctgttaatgtgtggacatattaacactgaaagccattattggccattaacaccttaacctgattttttatgggcatgagtcagattagtcatggatgaagaaagcacggaggaaaagatctagaacgcagggcattgctaaggagggtggatgtacatgctgatatagggacagcttagagcattagggagctgctaagagagaagagggctggaatagcaagccaagagttacgtgggctcagagggaggaggaagccctcccaggtggcagtctgcgaaatgaggaaaggtcccatagagaagatgtcatttgagcagatctgttttgatagacagtatttagatgcagcctaaacgaagagaactgcatgggcagagactctgaggcaggaaagtactgtctagggcaagcttgggagagcagtgcagaattcatagtgtaacaagaacatataagggaagaaggagaggtcagggaaggtttattggaaagatgacagagaggaacctgagtgttaggctgagctacttatcagctatcttgttggcatatagcttctgctgactgctaatccaaggtgagttcacttcgtgggtggtagatgaatgccatttagtacacgtggaagttaccccagtgcctcccactttagactacaggtcataactcggtgtgggagtagagccattccacccatggccaggaaagctgtgcccagttacaagtcctgtgacgccttaacataggaatagttctgtttttcaaacaagttgtcgagaagttaccaagaaaataaagaaccttcttcccacagaagaaggcagccagaatacccaagtcctagaaaacactatattgcaaaattagaacaaataataagatgtcttggccgggcgcggtggctcatgactgtaatcccagcactttgggaggccaagctgggtggatcacctgagactgggagttcgagagcagcctgactaacgtggagaaaccccatctctactaaaaatacaaaactagccaggcatggtggcgcacgcctataatcccagctactcaggaggctgaagcagaagaatcacttgaacttgggaggcagaggttgtggtgagctgagatcgtgccattgcgctccagcctgggcaacagagtgaaactccatctcaaaaaaaaaaaaaaaaagatgtctccactggctgggggcaggaagggtgctaaggacatataagtggttctagtccaaaagtatcagtttgaaacagaaaagaagacaccacttgctcatcactttgtagacatgatagaaatcaaataaagaatctatattttgatggatatgttttctaaacaaatattctgctatatggtcatctagaatgaacttactgtggccaacagcctcttaggttaaaaataatcagctctttttttgcatatacaactgacagatgccaacagggtaaaaaactgtatttggaacacagtcttaaccctaaaggaatacattagaaaaaagagtgaagcgaaatatgctggaacagtaacaggttgcctccgggcaatgcaattgtgagtcagtgcaggttgtgacagtgaatatgcttcttaacacttctccgtacttgaacatttttgttcagtaatcatatattattttgacagtcaagagaaaaagtattcagaaggttgaagggaaaaatgcggtaatagaaaagtgacatccttagcaaactattacttatttgtcactgacctatcgccaaaccaggaaaggttgtgtcaaggtgagattaagtcattccaagcctggagtgtcctgtattgctgatgttctcctcccctgtcccctttttggttccataacagccatctatcaattcaccttttttttttcttttaatagttcatggatcctcactctccttggtttccagcacatcgtcagtttattctacagtgagtataaatcaatgctgtgtggctgtgatcatgagaactggggttcctttatcaaatgtgtcaagaataaaatatatgcatttatcctagggaaagcatttccattataaggggatcaattaattagggaacaagatttaaaattcacaaacagctattaattatattataccaaccccaaaatccagaactggctgccttgttaaagtggcattgtgctttaggtgataactatttagaatgtgtgagaagccttggccacctgctgatggacttggaaaataaaggccttgagcaatttattaatcctttgtctgcctcagtttctttctttctttctttttttatttgagacggagtctccctctgttgcccaggctggaatgcagtggcttgatctcggctcactgcaacctccgcctcctgggctcaggtgattctcctgcctcagcttcctgagtagctgggactataggcatgtgccaccacgcccagctaatttttgtatttttagtagagacagagtttcaccatattggccaggctggtctcaaactcctgaccttgtgatccacccacctcggcctcccaaagtgctggcattacaggcgtgagccatggtgcccgaacagcctcagtttctttatctgtaaagtagaaataatagcagttcctaccttatagaggtgtaatgaggattaaatgttataaagattacatttcactacaatataaactctttctagacaaggacatttttgtttttattcctagtgcctagaacagtacctagcacgtagtaggtattttttaagtaggtttgaaagaaatgggaaaatgaatctaaaacaatgaatatagtacacacagctcagagcaagcactcctaaatgctagctatcatccatgagagaggtttagtaaacgaaagccaaatgtaatcaaatacatttagatcttcagtactactggatttgttcagtagtatttactttttatagctgtacactatttattttattttattttagacagactctcgctctgtcgcccaggctggagtaaagtggcacgaccttggctcactgcaacctctgcctcctgggttcaagcaattctcctgcctcagcctcctgagtagctgggattacaggcaggcaccaccatgcctggctaatttttttacatttttagtagagacgggatttcaccatgttggccaggctgttcttgaactcctgacctcaagtgatccgcccatctcagcctcccgaagtgttgggattacaggcgtgagccaccgcgcatggctatagctgtatgctatttactttaaaaacagtaatttgggaatttctacagggaaaaaaaaagtctctttgttaattgtgaattggaaattctttagcccttaatcccatggaaacaaatgttttaataatttaggttttgataatgcctggtttctatatagcagaatacactgtgtatagctcctggaaaataagaggacaccccagaatcaagttaaagataccagggcctaacttaggcctgtattgagcaaacaaacttcagtgattgctgatatggtctgttttgaaggacctagaaacccttgcttctacccacctcacccctccaactctaaaattcctctttcctcagctagtcatcttgtttgaaatttcatcactaagtcctagctttccttttaaaggctttatatagagtaaccttggagagaggttttttaagccatcatctgctaagaaagcatagagatggtctttcagctgtcagccagtagataaactatgtcctttcttctagaatgaaactgtgggatatgggtaccaaggctggtactttcaaacctaaatgcacttcttcaacagtatttactagcaccatggatataccaggctctggactaacccctaggatataatttaggagagaaaggagcctgctactgacggaggaagctgtaggcaccagagggacatgggactctagcttcacaggactggcacagagaagctgtagtggatgtttcagtgcccagccccgtgttttccctgtggcattcccaagggttcttgccaacacagaggggagtgggttttccagaagagtaaaaaaatgggagactggccagcattatgcagacttggagggaaagagcttaagcttctcaacctgtgtgtcttcagatctaggaaactgtcacatgcagttcctgggggcagccccttcatgccaaccactagaagtccttacagtaaaagactctccttcagtagctgttgttctgggtatggggacgtgaagatactgttttcatgaaatttgaaattgtcttttctgagctaatataaattcaatgaattagtaaagacctaataataatacttttgaattccatttttatctggataacaagagacccgaggtgtaatcatagcgttcttctcaccatatgactttggacaagtcatctggttattcagagtgtctccccagttttgcccttggcatcaggaaaccaagcaaggtgatcttctgaggcccctacaatctctgacattccatgagtcatggagtcaaaggctcccatttactgtcctcagtatgccttctctgagaatataggttgcttttgcagacttaaaaaaaaatagcctatcagtggaatgtttttatgctggtgctgtctactaatttcaagaaaaactacaagtctggctagactctgctaccgcctagcactgaggtgtggtcctttatctgttattacattcttcgtgataatgaaattctgaaacacatgctccaggcacctttgtaaatgttaaggtgaataaagtatttgtttgttgtctgaaaagagatctttgaaatgttaagttgccacagacccagaccaaggagcctgctgagagttttaaaggctcttattggatgacagtagattctttccttgaaatgtctataatgaatattcaagaatgctcattctgcatgaaatttgcaattttaattatcagtgaaagaaaagattacacagtgctaaatgattgccatggaaaagttatggctacctcttggagtagagaaaatctcaaaggccacttctggcattagacttgctttcttgtttggtagggaacactggagttcccaggagagctgctggatggatggaggctagcagcttcacatagtgttaccagatgtgcagaacagcggcaaggggggcaagatacaaagcacatgctttctctaggctgctgttgataattggggcccaaccccagagacaggtgggcacagtgacagacagtggcagaggcatggggaagggctgttagggcctgtcgatagaagtgtttcaaagtagccttgtcctatgtggatggctaagcctgctaacaggcctccgccagccttctaaatgttagatagtggttacattctcaccattaacttgtaccctttggattgaacttggggcttatttctggaaagcccccgtgagaatgtaactatagtaaaagtgcaggagaatatgcctaggctctggagccagactactttagatccagtcccaactctgccacttaccagctgtgaccctggacaaatgactgaaccttcctgtgcctcagtttcctcatacacaaaacagaaagcaatagtattagtacctcctcaaagagttgttaaaaggattagatgaataatgaatgtaaagtgcttggaacagtctctggcacatggtaagcattcaataaatgctagctgttattaccagaatgcaggcaacacaaggtcagggacttggtcatgttcacggctctatcttaggttcttaaaaatagtgcctggcacacagtaggaaatcagtaagtatttgataggtggtggtagtgaggatagatggacagacaaagacaaatgaatattatctgggagggaagattgagctctgaagacatcttccaaccttctcctgaaagcatttcttagataaggaggttgttcagtgtgactttatacaagacatttaacgtctctgaacctcagaaggaatacaaacaaacctacctaatggagtttctgcaaggattaaatgacttggctccgtgtatttaaaaattggttgctgctagtaggagccaacctagaggaggggacttgtgggcaggatcaggagggaggacaatggggagcataggttgaaggcggatcagacaggaagcagctgcctacctattccagctgatggatgtgccctgcgagttctaatgaatcatacccactttgtattgtgaactaatggagatgctgacatcagggtcagatgctgatttttaaaaaataatgggcttatgcctagtaaaattggattaggacacctagcgaggacccaaggacaaaatagagttcttactgatgttcactcacctatctggttcccaagtcactcttccctccctgggtacagcgatgggtagagagaaggtcaggaacactcaacatttccaggaaggaggagggttcctctttatgagcccctgtgggaaccagaggagagggaaagaaaggttcctcctgcagcaggctccccaattcatgtgggctccccctgtgggaggagagagggtcttatagtttctggctagcaggtacctgtgtcacctagacacagagccagcatgtaagggacaaagagggaagccagtaagaggggcagcagagttcacgattacttcacagggtcacaggtaattggggtccttgaaatgggacagcacgaagatgaaggccacatttatcctcacaacctgtggagttaccaggctggctgataggggctcccaaacccccctcactttgagatctttctaccctggtgctcccactgtggtgtcctagggaagtgagaggagggcagaaaatggggcagaattaacccaggagcagtcttccttgctccctagacagggttgccagagaaaatactaaaccctcaattaaatgtgaaatttagattaacaacaaaattttttttagtataaatatgtccctaatattgcatgggacatattagaccctttattttattttttgagacgggtagcctctgttgcccaggctagagtgcagtggtgtgatctcagctcactgcaatctccacctcctgggttcaagccattctcctgcctcagcctcccaagtagctgggattatgggtgcatgccatcacacccggctaattttttttttttttttttgtatttttagtagagatgggtttcaccatgttggccaggctggtcttcaactcctgacctcaagtggtccaccaacctcagcctcccaaagtactgggatgtcaggcatgagctaccatgcccagtcctagacctttttgttttttttaaagctattcaaatttaactaggcctcctgtatttttgtttactaaatctgactcatggccttcttatcacatatcttcttctgagcactttacctatcaccatccccgcctggggagcagggtggctcctcacaaccaaaatgtggagtggtgttctcattcttcctaatttttaaaaatcataagccgtttgtatttggcctttctgatgggtcaatttaattgaaccagtttttccagagaaatacaccagaaaagaaactaataattcttccagactgctgcaaccatctgaatatggtgttcccgatgggctggactacactattctttgttccttaactggtctaatttcctttatgttttctttacagccagaagaaaaatgccagtcagaggtaaggaacagctttctggttggatttcctctttaagtattgtcaattatttgaccctgctcaccttggaaatggacccccaaagcatgtaaccctctcccttgtcatctttagattcgcaagctgcggcgggaactggatgcctcccaggagaaagtttcagctttgaccacccagctgacagcaaatgtaagtacagacatagggcagtagcatcgggacaggaagcaccatccttgccttctgaacagcctcaagtcctcctgtgctgaacaaatagaagtagcacattataaagaaaaagacacaggctttggcatcatgggtgtgaatgtcagtttggacacttactggctttgtgactttgggtaagttcttgaatctcagcctgcgtgtccttatctgtgtaacgagggtgatagtatttacatctcagtattggcccacagtcaatgcttgcaatatgcgaagtgcttattaaaatcttaatttctcttcctctttctgaaaattttgattttaagggtgggaaaaagaagcaaaaaggaaagaagggggaagaaaagaaatgtagggcttttcaatatctaggtagctgctctgtcattgtgatatacacgattatgagtttaggagatgctgccaaccagcattcaattcaacaactgtttgagtgccagctatgccccgggcactgtgggttcaacagcagagcaagcacagtgactgacatcttaacattcagtctctgggacagcagagaaacaaaacaaacaattttgctataacatgataactgttaagataaagggaggaggtggcagtgggaatatctagggggagcacctagctcactcttggtgggggatgaaaaaggggacagctcatctgatattgaaaataagaaaaaaattttttaaaagggggacaggaaggacttcctggaggaggtgacatctaatggatgctaggtaggggagaatgcatagggatgacagcattctaaccaaagagaataatttgcacaaaggttaaggagaaagatcttggtgtattttgaactctcagtaggtgggtgtaattagtgtctatggcttggatgtggaggagaggtaagggtggagaggggacagaagtagggaggaagaaggcagcgaagaaagccaggggtcagatcacagtgtctgagctgttggggtgagcatccgggcttcctcctgaagttagcagacacctctcagtgcgttttaagtaagcagtgggtgggctggtttgcactttagatagaggatcagagtagaggcagaggtgcctcttcccccacccccatcagccatgtctgtattggagccctgatgcacagctgtgaccaggtgaaggatgaagctcagagggcagagcctgagatatcgaaaggtgctaaggtgcctctgaggcaaggcttgctgcccaggagttcaccacccagcctgagcccgttgataaacgtgttcaagccagacagaaagcaacctgcatgaccacagcatgtcgttaaaatggaaaccaacttcaagaggctgtcttccctcaactagaaaactgagccagtcccccacatcagtcattcgcccggagtttttgccatggtattcccagcttgagccttagtttactcaagggaaccatttctctttaaggtcggcatgtgacatacctagtacagtgcttgaccttagttattagctcagtaactggtagctgcccccattaatatgtagtctcctaagttctctttcttttctggaaatctttgatttttttaaaaaccctaacgtaggagaccacaacgtgttttgtaatcttttattttctttacctcttctgccaccagtaatgctatcaaaagaactttaaaaactgacatgagaacttaattctgaggcgtaggtcctgttcagaaaaacagtattctatagacaggttctatcccgtgggcagattcttcatctggataactagatgtgtagatttgaatccagaacaaaccctagacccagcaagtcagggtcttctgagtgtaatccaaatgtgtggtttgacagcaaacccctgtcaaaccacagtgattctgagctactctcctagtttaagagttacagatgccaattgttgcctttactaatcaacaaatagtagttaacttactttccggtgaacttgggttaattgttccagtgacctcgtgctgccacaggagcctcaccttgggccatttggaactctgctctctgttctagaagagtcagagtgagatcccttatattattccagaagagtgttttgttcctcataaaaggcactgaatccagtattgttttaaagtaaatatttagtcttaccgcacactgctggaagggtgaacatgttttattgtctgccatctttctcgcaaaccaagctgtgtttgtttttctagggcaaactactcaaaaccaccttctctgagtgtttttataccacttgtgtttgttttccctgggaatgtgagcgtggcacttgatgagtaggctgttgtgtgtggctctgaaccaggcttggaacagcctccacagtctgtattttcatagttgtgctaatgacacaaaggcaacccttttgtttagcagaaaaatgggatcctctggatctccagagcaaatgtgttttctttttaagcttgcaaaaacaccttctcaatagcagtcttcatggggtcaggttttttaaattttttttttattatactttaagttctggggtacatgtgcagaatgtgcaggttcgttacgtacgtatacatgtgccatggtggtttgctgcacccatcaactcgtcatctacattaggcatttctcctaatactatccctcccctagccccccaccccccgacaggccctggtgtctgatgttcccctccatgtatccatgtgccatgtgttctcattgttcaactcccacttatgaatgagaacatccagtgtttggtttttggttcttgtgttagtttgctgagaatgatggtttccagcttcatccatgtccctgaaaaggacatgaactcatcctttttatggctgcatagaattccatggtgtatatgtgccacatgtctttatccactctatcattgatgggcatttgggttggttccaaatctttgctattgtgaacagtgctgcaataaacatacgtgtgcatgcgtctttatagtaaaatgatttataatcctttgggggtatatacccagtaatgggattgctgggtcaaatggtatttctagttctagatccttgaggaattgccacactgtcttacataatggttgaactaatttacactctcatcaacagtataaaagtgttcctatttctccacatcctctccagcatctgttgttccttgactttttaatgattgccattctaactgacatgagatggtatctcattgtggttttgatttgcatttcttcatatgtttgttggctgcataaatgtcttcttttgaaaagtgtctgttcatatccttcacccactaaatgggtgggtgggtgtttttttcttgtaaatttgtttaagttctttataaatttgtttaagttctggatattagccctttgtcagatggatagattgcaaaaattttcttcaatgttgtaggttgcctgttcactctgatgaagtttcttttgctgtgcagaagctctttaattagatcccttttgtctattttggttttgttcccattgcttttgatattttagtcatgaaggctttgcccatgcctatgtcctgaatagtattgcctaggttttcttctaaggtttttatgattttaggtcttaggtttaattctttaatccatcttgggttaatttttgtatgaggtgtaaggaaggggtccagtttcagctttctgcatatggctagccagttttgccaacaccatttattaaatagggaatcctttccccattgcttgtttttgtcaggtttgtcaaagatcagatggttgtagatgtgtggcattatttctgaggcctctgttctgtcccattggtctatatatctgttttggtaccagtaccatgctgttttggttactgtagccttgtagtatagtttgaagtcagtgtgatgtctccagctttgttctttttgcttaagattgtcttggctaggcagactcttttttggttccatatgaaatttaaagtagtttttttacaattctgtgaagaaagtcattggtagcttgatggggatagcattgaatctataaattactttgggcagtatggccattttcatgatattgattcttactatccatgaacatggaatgtttttgcatttgtttatgtcctctcttatttccttgagcagtggtttgtagttctccttcaagaggtccttcacgtcccttgtaagttgtattcctaggtattttattctctttgtagcaattgtgaatgggagttcactcatgatttggttctctgtttttctgttattggcgtataggaatgcttgtgatttttgcacattgattttgtatcctgagatgttgctgaagttgcttatcaggttaaggagattttgggctgagaagatggggttttctaaacatacaatcatgttatctgcaaacagagacaatttgacttcctgttttcccaattgaataccctttatttccttctcttgcttgattgccctggccagaacttccaatactatgttgaataggagcggtgagagagggcatccttgtcttgtgccagttttcaaagggaatgcttccagtctttgcccattcagtatgatattggctgtgggtttgtcataaatagctcttattattttgagatacattccatcaatatctagtttattaagagtgtttagcatgaagggctgttgaatttgtccaaggccttttctgcatctattgagataatcatgtggtttttgtctttggttctgtttatgtgatggattacatttattgattttcttatgttgaaccagccttgcatcccagggatgaagcccacttgatcatggtggataagctttttgatgtgctgctggatttggtttgccagtattttaccgaggattttcacattgatgttcatcaaggatattggcctgaaattttctttttttgttttgtctttgccaggttttggtatcaggatgatgctggcctcataaaatgagccagggaggattccttctttttctattatttggaatagtttcacaaggaatggtactagatcctctttgtacctctggtaaaatttggatgtgaatccatctagttctggactttttttggttggtaggctattaattgctgcctcaatgtcagaacttcttattggtcttctcagggatttgacttcttcctggtttagtcttgggagggtgtatgtgtccaggaatttatccatttcttctagattttctagtttgcttacgtagagctgtttatagtattctctgatggtagtttgtatttctgtgggattggtggtgatatcccctttatcattttctattgcatcttatttgattcttttctcttttcttctgtattagtctggctagcagtctattttgttgatcttttcaaaaaacgacctcctggattcactgattttttgaagggttttttgtgtctctatctccttcagttctgctctgatcttagttatttcttgtcttctgctagcttttgaatttgtttgctcttgcttctctagttcttttaattgtgatctcagggtgtcgattttagatctttcctgctttctcttgtgggcatttagtgctataaatttccctctacacactgctttaaatgtgtcccagatattctagtatgttgtatctttgttctcattggtttcaaagaacatctttatttctgccttcatttccttatgtacccagtagtcattcaggagcaggttgttcagtttccatgtagttgtgtggttttgagtgagtttcttattcatgagttctaatttgattgcactgtggtctgagagtctgtttgctatgatttccattcttttgcatttgctgaggagtgttttacttccgattatgtggtcaattttagaataagtgtgatgtggtgctgagaagaacatattttctgttgatgtggggttgagagttctgtagatgtctattaggtgtgcttggtccagagatgagctcaagtcctggatatccttgttaattttctgttttgttcatctgtctaatattgacagtagggtgttaaagtctcccactgttattgtgtgggagtctaagtctctttgtaggtctctaaggacttgctttatgaatctgggtgctcctgttttgggtgcatatatatttaggatagtgagctcttcttgttgcattgatctctttaccgtcatgtaatggccttctttgtatctttttatctttcttggtttaaagtctgttttattggagactaggattgcaactctgcttttttttttttttttgctttccatttgcttggtaaatattccttcatccctttattttgagcctatgtctgtctttgcacgtgagatgggtctcctgaatacagcacactgaagggtctgggctctttatccaatttgtcagtctgtgtcttttgattggggcatttagcctgtttacaataggaatgcccgtaagtggagtcatgggtgacaatcaaatgcagaactgaaatcaatggaaatccaatcatttacatttaactttgtcattcatttgcaatatgaggatagtaaatgttctttgaaacatccaggccctggcctgtttcctttgtcaactatgtgactgtcataaattgattggcttttgttttgccacactctccagggcagactaaagcatatctctttattttaaaatgcagaggcactgtctccatgttttttgtttttttgttttgttttttttttttttgagacagagtctcatcccgctctgttgcccaggctggagtgcagtggcacaatcttggctcactgcaagctccgcctcccgggttcacgccattctcctgcctcagcctcccgagtagctgggactacaggtgcccaccaccatgcccagctagttttttgtttgtttgtttgtttttgtatttttagtagagacggggtttcaccgtgttagccaggatagtctcgatctcctgacctcagggtccgcccgccttagcctcccaaagtgctgggattacaggcatgagctaccacgcctggcctgtctccatttttaatagagagagggagtgcaatgagagagaagctaactattccacttaacatttctactacaagtagaaatgctccctgccagcggttgattctagagatgtcttagcctccaccatccctgtttaatgaagtctaataacaggcctctctttacccctcacatctctccttagattgaaatgtcactgtgcctcctcacagtgcacggcaaaagcatctccccacccaccccccatgcttatccagcgttgattcctcactgtgtgtgtcagtcatctcctcctctcgaatttcacagcatgatcaaatctcacatctcccaagctcctcccatatatcctctgcccttctcatccctcttgcagcccactgtgtttctactccccctgtctacacctgtgttctcaggtagtctcactcctctcatagtttctcttgtcactttctcattcccaaacctccttttttccccacaagtgtccatgcattcctgtgttttgcagtacctgaacagttcatagaccattttcaccggccttgtttcatttagctgaaaataaccctgggaggaaaatagatattggtaccatttcatatatgaagctgaggctgctaggatcaggtgatttgctctgttatgggtattcagaaggaactacagggagagctgaagacctctaactctaaatcctgttcccttcccctgtactacactgcctccttcatctaagtgcttttcttttcaatcctttaattgctcatccaacatatatgattgagtggctgtttttgtaccagcagtgtggatacagtaaggagcaaggtagacatggtgtcagtcctcatcaaatgcacaatctggtgatccttctcatctgctgctcaaatgcctctcactcttggacatgccactattccattatacaagtagagattggagattagaagatcctagctgcctaatggcttcttcagtctattgctggaaattccttagcatgactgtttgaaacagctccattctttatttttggctttaataacattaccaggattctcattcaatcaactaatatatcacctactactctgcttcacagtcaaaagcttagtgttagggcacaaagttacctcttacccttgaagagagttgcagagcaagtggcagtcaggaaaatgccacatttccccattcttaaacttactctttttttgtattttaacatctctgaaaattagatgctattttacttataactggaagcatttaaaaaattcttagaaatataaaataatggtacatcttatgtcatattctaacagaagtgtataaaactacgtgaaagcctgtgggaaagtggtaaccccctggaggaactgggaaacatttctctgaggaggtagcagatgggcctttcagtggctttttattaaccaggattataacaagcaaactacgccaaccattttgtttgttcattctactaacatgcttaatatgagcctctattgtgagcttagcacttggtgaacagaagatcatcctccattgtagtagagaagacagacatacattaccaattacaagactgcatgtatttttaactatgatatctcaaagtgtatatcagaagtacagtttgcttgtgagagtgcatatgagggtgtcgtgaaagtacgagccgagagctctttacacagacaggtaaaaattattaggcaaggaatgggagaaagggttgagagggaagaacatttcaggtagaggggaaaagatgtacaagggccctaagatgggaaggagcacgggttgtttgagcaagtagaagactggagtgactggatcccaaagagtggtggggagtgggattcaagaggaggctgaaaaagtagcctagatcaatggacccacaggattttcatctttaagagccagacaccttctaagcactcttgccttgcaaggtaatataactgaggttgtgtcttcccctccaggctcaccttgtggcagcctttgaacagagtcttggtaacatgacaatcaggctccagagtctgaccatgacagctgagcagaaggtaaggcagaaaggatactttaaccctccctacttggagttaacaacaaacttgaaaatactattctttcatttcagatcattgtgtggatgttaatgtatttcttgaactgttaaagtttaattgtaaggagtccaatctgttgagtgaaaatatgacagattgataatggcatcaatgatagatcttgtagttataatcctacttttatgtgtttgttcatgcctgttgatccatctgaaaggttttgttgagctacttcattcccgctcctcctgtgttgaagccaagttgtacttcagttgaactctgtacagaatgattttaggctgaccaataattttttctgttccctaggactcagaactgaatgagttaagaaaaaccattgagctgctaaagaaacagaacgcagctgcccaggctgccattaatggagtaattaacacacctgagctcaactgcaaaggtaaagtaagggaaacagcctttagccagaagacctgcctgcccttaggagccctcccctgacatcatatgatgcaacctccttgctagaagacagtgtctgcgtaattcagctccatgtcaggcaagcaggaactggaaggcaaacacctttaatcaagtcacttctggcctctacaaagatggctatggtagttcatcttcttctctgatatatctgaaaaatggaagaaaacatgtttctattggcagagtgttaaagtattttacaacccttaatttcactagcactttgatatttgcatgctgatatatggcataagctgaactgagttcctcccttatttgtccaagaaaagatttctttttttttctgagacactcttgctctgtcacccaggttgaagtgcagtggtgcaatcttggctcactgcaacctctacttcccgggttcaagtgattctcctgcctcagcctcccaagtagctgggattacaggcatgtgccagcatgcctggctaatttatgtattcttagtagagacaggtcttgccatgttggctgggctggtcttgaactcctgtcctcaagcaatccgctcacctcggcctccgaaagtgctaggattacgagcatgagccaccatgcccagcctaggaaaacatttctaagtgaattattttgtccttgtgtatcttggggtaatgtaggagtgcaggtgacttagctcttataacaataatattaacagtaatagtaatcacagaagtaatatggagagctaggatttatggaatacttactacgttctaagggcagtgctaagtgtttcaatgatttcattatctggttttctttctacaacaatcttgtgagtgtgattctgttctttcctgcttgtactgatgaggacactagtgttcatagatgagagtcacttcctttttctttttttgagacggagtttcactctgttgcccaggctggagtgcactggcatgatctccgctcactgtaacctctgcctcctgcgttcaagtgattctcctgcctccacctcctgagtagctgggactacaggcgcatgcgaacacgcctggctggtttttgtatttttagtagagacagggtttcaccatgttggccaggctggtctcgaacttctgacctcaagtggtctgcctgctttggcttcctaaagtgctgggattacaggcatgatccactacacccggccgagggtcactttttaaggtcagggattagggagaaactgaagtggggctagaacctgatgagttggtttgaccctacaactagtgttctcaaagaccagcctttaggtgtagttctgtcctcatgagaaaaactatctgcaaactttatgtcagatatcacacattttcaatatcggtgttgtttagtctattgggcctcccgaaaaagtgataatagctttgaaatgggaaggatttgcaaatgagttggctggacagagtcaagggaaaagaatatccagatagagggatagcacatggaagggccctagatgaggcaggcatggcacttccagagggctgcaagaaggccactgtgacaggagcccagagagcaggagagggagggggctagcaatgaaggtgccaactgctcagttcacaagcacatttccacacctatctaaagcttaagagctggtgttggggaaattctccctacacctcccttgacttctgttttgtaaagtggggagagatagacctcatttaattgaccaaagagggcaatgcactcacctattcaaggatcttagaaacagctgtagggatcagagttgatgtatatgtggaaaacacccagtagtcctcaggtgggtgggttttgcttaaagggcaaaatcctgagataaagaatagggctcaggttggcagctgctgaaacaccctgccttggtctccaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtgagtgcacatccactctcctggggactgacggacagagtcagttgcagaactggctgctgcatctccccagataaagtccagcccagctactatctgtggaacatagcactttgggcgtagatcccaggaaatggtttgtggatgggtttttactaaaatcaatattgtactcagcaaaacactagaatctgtaacatccctaccactttgtatttttttctctttcatgagacttttcataaagtactcatctttcatttcatatgtgtgtcatttcttcctcattatatgttggccacaaagtttcaggtactagaggaaagttattcttaaatggtttcttcatagatccaaaatatttttttgagcatattgctagttatcccatctttagccgtaatctttatctatttatttacacaaatgcctagggatatcatcaaaccaaccctctctttgaaaactttttgaccatgtcctataaataaaagtgtcctaatgtcagtgttagaagttagcaagtagttctaaaccaggggttgtacctcaaatagcaagtttaatagaatcagtctccattacagtgtttctccatgtttcataatcccagtgagttatttgaatttctggacagtggtgccttgagtggttttttccactctcccagaaaaattccacccctcactctccatccagttttttaattcttctttaaaggctacagagctctgactgagatttgctatcccttgtcttcagtgcaagaatatctcaagttgatctggagttgaccagtggccccgttccccatttgtgctgacggcatcctgtttcactagtagcttcagtgtcctcattcattctgtacacttctcactcattttgtgttatcttggatgggtggcgaggtctagtgatacagacatcaggggtttagtaattttggttgtcaatgacttgcattggaagcaagctaaaaagccagtctagtgtgaccctctcatctttctgattaaattttcttttttaagttactaatggctcttagtcaacttatttgttatgactaaacacagataggattaattcatattgctgtctctaatatgcaatcgataaacatggtcagctttgattttcaaagtgacgagagagatattttctacgaaaaatagtggttattccattttcttcaagaaataaaacgtgcttatgttgctttaagacaactcccgcttatcagtcaaatcagggaagatggataattggcatcctcagctaatcccaaagcttagctctgtctgatctttgtaatctcctcttccacctggcttttcaccagaggtagaggcaaggatttcaggtgatggcttgtgtccctaatccttctgtttctgtgactgctctctggaaatattatcagaggtaggaaatgggagagaaaagggatctagatttgcccacaagctggacatgtggtttattatagatgaaacctgttgatgggagaaaaatctcatcagtttttagaatggcctgttttctgaatttttcagtggctaagaaaacccctggaacgtattttcacaaggaaaaaagactttagaaaaaggaaattacttttaaaaggcctgttttcaagatgaaacattagtttttggcctagaaaaatctgattatggctttcagagaagacattgcattttaattctttatgttctcattaaaatgtttaggtatccatttcctgcaacagaggcgggggggaaagaattttcagatccatctcatgatttggggaaattgtaatatactagttccttttccccccatatggttaataaatttctttaaaataaccattttctgagtaacaagtgacatggctaatttgctgcttattagattatcttcttatatacacaaatagctgaaactcctaagtggataggttaaggagctatacagccatccagggccagtgtgacagtgaagctagaattgctcaaaaagaagacatcctctccaacctcccccaaaatttaaagcacagagaggtgactgacaagaaaaaagaagagaatgagaagcacaggaaggtgggaggcagccatttcagccagacagggaaaagctggaagaactggaattgtagaggactccccaacctgctattcccttcctttcagaagggaggaacatgcccccagtgcttttaaagatttgtgttcctactggaaacctcccctgtgtgtggtgtttattattagccatgttgtgtctgaaagtccgaagctttccctgtcactggctttctctgttaaaaaattgtcttttttcctcccccttccccatttttgcttgcgttttctctggcaggtcaatgaggtaagcaagaccaactttaatatcagataccaagctaacccatccattgatatgactaacctcatccgcatccatcaccgtgtctgagcatcctgctttgttgctgtgtaacctcatcttcccaacatccatctgctgagccagactctgtgttgctgttggcatctagtcttgaaccaagagtaggcatggaatgttacccacagatgcagtccctcaagctggcaacaccagataactcttcctcccttaatgcactgattcaaaagagctcttgggaacctcttccattggtggggggaaaaacatgggagaattaatcgcttttttgtgtgcatgtctctgttttgccaaggcctaagcattggttgcccccgctgtgagactgacagtcttgtatattcagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctgtaagtctgtctgtctagtcagataacatctttggcccctgagaaccttctccagtaggaatggctaggagtcctgttatgacacatctgctccttgggatcctttatgctttgctttaataggactgtgcatgttctttcaatgctttaggactgggaaagttgaaagagaaaagaaacttaggttttcgttctgatggtgtcaatatccataactaactggttggccttaagcgggttacttaaattctctttgtttccatacctctatatatcaatttgggataatggtttttgtgtacgtatcctagccctaagaattggacgagataaatggatatacaggagcttgcttcctgcagcagtaagaaaggctggccctgctcagtagggctgaatttcttttgaaaccatggtgttccaggtctagaattaaagaactggagcacaggtagtctgcaaggaaagttgtcagagagatgagacagtgcatgggagaagagggaagtcatggccagggtcaggacagccactgagatagggttagagaaagaagtttggttgtataaacttcagtttcctcactagtaaaaatagggttcattacatctacttcactggattcttgggaaggccaagttaaatactatgcatgaagggccttttccatgctgttccatctttcttcattctcagggggccaggtctgtgccgctgaccctaagtccacttaaccagccagcccactgaagacagcataagtgtcttaaggccctgccttagcagcttaccagatgggtagagggagtacaggcaaaatcagcctgtccagaggccagatctttgtagtataccaactgcatgggagtggaagagaggaaacagaggatagtagggttatgaccttcttttggttttggttttggttttgtttttgagatggagtcttgctctgttgcccaggctggagtgcagaggcatgatctcggctcactgcaacttctgctgcccaggtgcaagcaattctcctgtctcagcctcctgaatagctgggactacaggcgcatgccaccatgcccagctaatttttgtagttttagtagagacgaggtttcaccgtattggtcaatctggtctcgaactcctgacctcaggtgatccacctgcttcagcctcccaaagtgcttggattacaggcatgagccactgcacccaaccagggttatgacttttaagcaacctcacccactattgaaacatggccctgtcagggtctctactttactgagttagatgatcaattcctcttttcttggagaacaccctagtaagaggtagccacaggggtgtgtacttcctactgctatgggtgagggtaaaattgaatgggggaaggaagaaggacactgagggactggacttcggtttggccctgcagtgcccagcccagtgtcctgtgttattttgagtgaagaattagacaaattactgagagagtgtgtcctcctccatctgcagagtgcctaaggaaagagtaaagaaccagttgcctgtgactctcacacatgccatcatcccaaagcatcccaactcagttgtctcctgaccaggagaaaaaggaactcatcatgtcttctttatttattgatttaaactttttgtatagcaacctgtgtgagcagagcactattccagatgctctgaagagaccaaaaaggggttaaccaagccaggtgcagttactgtcgcctgtaatcccagcgctttgggaggccaaggagggaggattgcttgaggccaagagctggcaaccagcctggtcaatatagtgagactctgtctctacaaaaaaaaattttttttaatcggtcaggcatggtgttgcatacttgtagtcccagctacttgggaggctgaggcaggagggtcacttgagcccaggaatttgagactccagtgagctgtgatcaccctgtactccagcctgggtgacagagtaaggccatgtctctatttaaaaaaaaaaaaaaagttaaacagattctccacccctgagaagagtaaatactagtggagacatgacatagtacagttcattctactcctgaactttcactctgaaggccccattctcagttgtggttacgataaagtacaacacaaagttcctactcatggaccctgtataccaagagaggagatgaatgttaaacaaataaatcctgaataaactaggaaaattagagagtgctaagggctaatgctgtgaattaaaacagtgctgagatacagagtaccttggcagcaactttagatggggtggtcagaaaagagccctctgagtaggtgacatttcagctgaatctgcatgccagggggagccactgggttagtttcagcgggtaacattagctgctgtaacaaactcagcccaacgctcagcagctttacatatgactgtttatttcttgctcactccaaacccagtgcagatagtcctagtcagcaggtggcctgccctctagtgatgtaggcactgaggctcccgccatccacagggcccagtccactgctcaacattctgtgtccagccagtgggcgtgggggtttggagagtgcagaggaacctgcaggagggttttaaggaccaggcctagaagaggcttatgtcgcctcttcccacagtccactgaccaggactcaaagccataccacctgcagcagaagaagtgaaggaggaaatgggctttggtgaacacatagcagcctctgccaccccagcctcccaatgagcagggcagtcttcctgacccaaaaaataaataacacaaggagcctgatgtagaaacaggttcgatatgtctgaaagagagagggatggacagcgtgacttcccacatatgcgagtaggctacagccacagacatagtcagggcctagaacacgcaaggctttgaagtgaattcgcatccaatttcatgtataatgggtgggtgtggtggagtttgaaacaggaatatgagataatctgaatttacaaagatcagtctctgttctgtgtataaggaatatggggaagggagatcacccaggggctcttagccactctggcccacttgttctttgaacattccaatcacactctccacctcaaggcctgtgtccttcctgtgtcctctgcctggtgtgctcttccctcagatatttatttccttaggtctctgctcaatgtgacttaatgaataaggccttgcccattcacttgcataaaccaacattctaccatgagccagtgctccccatggtccctttgcccctgcttcatttttccccattgcacatgttgccccctgacacctgacatagaggttttccttgattatttgttctctgtcccccaccccaaccccagatctacagtagaagctccatggaggtaagtactgtattggttttgcaggcactcaaatatttggtggaatgaatgagccactgataacagtagtgagttctggatgtatttaggagatattcttgaagaaaagttgacagtgtatggtgatggatcagatgtgagtgcaagggaaagaggagagccatcctgggatattcctagatttacaacttgagtacctgggatgagtgggagacacagaggggggcagagtggggagtcggagcactactttggttccattaaatttgagatgccagcagacatccatatccaggtcaaccagcctggacttcctagaggtgtagatttgggagacacagacttattggtggtgtcgaaagctgggcaactggaagagttctccaaggggttgaatgaagacgaagatgatcagagggcaagagggcaagaggactgagctctggtgcactctgatatttgaagttcagaaagagggagttacagctgccggccagcaaggtgggaggaaacctgggagcagagaggagaaactgttgctggagggagtaggaacggggccagatgctgctgggcggccaagtaagatgagcagagagaggcggtgatgcactcagctgtgcaggaccatggcagaactatcctccaagccactttccccagaggaatcgggtggggttggctcctggctccccagcccttttcttacattccacagcatccatgcacactggagatgtttgtttttggtctcgttttccaaagggtaggctgagagcaaatgcttgtttccaacctcgaagggtttgtaagaatgtgcaaatctagatgtgagagggagttcaaagacaaaaccataggcagaggagttgggcttaggaaattccccaatccgtgggcaaaaggaatggtagttgtggtaaggcaacgttttcccacactcgaggcattttaaaattaggtatgccaccagccctgactgtggacaagacagtggaaaaaggcttgaatcacagttaagggactgagtagggaaaaacacacataaggtgtcttcagtaagcagtttatgaagtggacaagcatgtattgagcgcctagtgggtatagttcaggaacacaggctctagagctgagcagacctgccaggtttgaatctgcctctatcatttttacatggtgcagtcttgggcctgcttgtgtccatgtctctgcctccccattttaaaactggagataattacagtacctcttcatggagtgagtaatgtacaaaggaaatggaataatatacttcaaatacctagcccatttgtttaggtattccataagcatttgttaggtacccattatgtaaatgtgatcagatgccagaaatgatgcagagaataaccctggtccctgaggagccagcagccaagcagaggtaacatgttaagttgaaatgaaattatcagcgatacagcataagtctagtcagggaaggaactaggggagaaggctctgtcttgggcattaggattagggactaaagcttagttaaggctgctgcaaaagaatgtgttttcttttttgttttgagactgagtttcgctcttgcctcccaggctgtagtgcagtggcgcgatcttggctcactgcaacctcgacctctcaggttcaagcgattctcctgcctcagcctcctgagtagccgggattacaagtgcccgccaccaaagctacaccacccagctaatttgtgtatttttagtagagacggggtttcgccgtgttggccaggcttgtctcgaactccccacctcagatgatccacctgcctcagctgggattacaggcgtgagccgccaacccgggccaagaatgtgttttcaacatcatgtctacgttatagggcatctgtctcatgaggcctcatcattgtgtgtttctgagagctggctgattctggaggagcatagggaggacaaagtcctcccaacacagactttcttcatttcagtttggtaccgtttgtaaagtcaagggtttaggccaagctctgcaaagtaacccatgtgatacgttccacaacgtgagtgccaagaaggtattttctctcttgctgagagctttctgggaaaagggtgcagatcaggtgaagatgacttgagcaaggtgccttatcgtggagtgctggacagacgagcctcacatggtgtcagccagaacagactgttctctgcagtgaatctgagccttcaagattcatgtaggacatgatttggctaagaagggagtatcacagtgaaattttgttcagactttacactccatttaaaccaagaaaccatagtcttctcaagatagaaccagtttttgcaagctcctcctgcaaacctcccaaaccgaagaaaaaaaaaaaaagcatggttctatcagtaaacctcacaaaccacaggctattcaaagtacagagagctgagaaagaaaggatgttgcaaattctaaagacatttctgtctcgcccttttagtcctgaatctattggcttcagtctctcaaaagtgtgagatggaaataattagatcattttcaggagttctttgggtttttcaataagattttgaagctaagaatcttccttggtgactggtaacttttaaaaacataaggtggttttaccgtgtctctcaaatcaaaaaagttcaggttcaggtcaagaaaagagcaacagaaacatttggctattcaagtgttaaatttttcttccagttctttctgcccccgaaatacaatttcatctcttttaacaattttataaatcattttcctttgggaattaaaatttccacaccctcacccagttttacaggtcaggttttgtttggccccaaacccatagcttgggtcttggagagccagactcatgtgatcatttatttctgcagagaccacatgctcatcatctcctttagacataatcagcttcagctttgtaactttatgaacttgagagtgggggtgtttggggttgtttttctgtcttcagtccaagaaatgtcaaagctttctattctggatcacccagtaacccagatgctaagatcgtcgaaactcacagaactattttttttaagagaactatctttcctaacattgcaattcatcacgacttgtatgatcttctactttgtgctgatttgccaggtgtttgaagagcaaacctaagtaactaaggagcctaagctagaagaaccacctcttcagaaagaggaactcaacagggtcccatggtgaccttgacctggtgtgcagcagggaaaagaagataattagccaggctgttgcagagttttcagatacaactttggcttgcctgtcacaccatcccgtctgttctctaactccctgaagaggtttcccttcttgccctgagtgtgttaagcagtgtgggggctgagagaactaaagaaggttgatctgtctagacacttttaggggagtgagttttcagaatgtgatcaggaacagattaacaccttccacgcatatctttaggtttcatccccattttggcaaataaaaatcacccctcagttgtttaataaagaagtttctaatctttaaaactgtaagctgaccctgcttctctgagtcggtttggaactcaagggcgtgtggtgtcatggaagcccagctgtgtacacatggtgggggagggggttatcaaactggaaggttactactcccttttgccagctcctgcttatccttatattcctggaattttgctgaaaggcacaccaaagccattctgattgccagagctcagcaaagaaagaatgtagagaatgaaatcttgtctctaaaaataaaaataaaaataaaatttaaaaagtgaaaccacaaaaagcaggaaaagagtgaaagacaaaagtaggaactcaggaaaagagtgaaagacaaaaataggaacaaagaaaaaggacaacaaatagaaaagtaacaatacagtaaataataatctaactatattaacgattttaaacatcagtggtctaaataaaccaatttaaagaagaaaaaaagaatacagagaaggaataaaatctgttttcaggtgcttttggcattgtcacccacaggaagcaccaggcagctggttattcacagttactgctaaacaaacctgatgattgatgtggaccagtgttcagtaggggactaaaaggagctgctttcatcagtaacattcctctttccctagaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcaggtgagagcccaggagcatgggctgagctcaaggctgtctatgaaggagctcccagaggctgctctccactaagccctgagggctgcatcagaatctggtggcggccctcgctttcccagcctttatctcttttcagtccctcccacacattgctcaaagacccagtcttttggaagaataagagtacccatgctcttcctttacgtaatacttttggtgactcccctggtgcctgtggcatgtggtacagtctccttcagctggccttcaaggccttctgcagggtcgtttccactgttaatccacaccaccctccccagctcctcttcccagaatctactcgccagccagatggagtcgctgactgccccctttgcatccttggaaattcctctttcatattgttccctccactgggtatattcctctgcacatccaagttagacccttcccttaatgctcggcctgattcctttccaagtcttgcagctggagagttagtacccttatctgagtattcctgtagatttgttcttacagcccctcccaccttctgccatggagtgaagacatttgggtcttctgggctttttgcatacctttctgtggacatagcaccaatgccttgcacattgtaggttcttcatgaatattcgtagaatgaaagatacctctagagtctgctgggatcttaatggagtcagtgtttcacaaaggaggttccctgaaacactctttccatgagaagctctatgaaaggagaataccttgatcaaatatgtttggaaaatgctgcacaccatgtgcctctgttcaattcatggcgtagaggagctcattaaagattctgagaagtcctgcaggaaagaagcctgtaaaagccagagttgcacaaacctcttagatcataagactctttttcacttaaccctcaagcagcagactctgggaagcatttcagaggtcttttcaaaggcctgttctctgaatggatggacctcccatggcagcatgtcttatgtctaccgcagggttagcaaacactgctaaatctctctgagggtgttgttcgccttgggtggaagaccagcctggtttctgcagggaactttcagatccttccttcagaaaaatcttgttcacattacttctgcctactaagggagcttctccattactctttgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctgggtgagtggcctacagggtttgggggcaggaatggacctacagctggcaccctgatctctaagcgagaaccccaaaataagcagatcaacagatcaaatggagaggcaacaggcgtgtgtgcacttggggtgtgtatgtgtctgggtgtgagtctgctaccaacatgagcccagccgttagactgctctcatgctttgctccagcaccccaaattctccaagccctgagcttggatcccctcgcccaccatgctgagtttgtttgatccattttaagaggctgacctgcaagctgaatgctgtacacaaaccccatagtagcaggtctcagttgaggcagtggcttggtctatgatcttcctgccttcaggatggattccaggctggtgcaaccatcagtgaacacaatctaggttttctttgtaagcgtattaaggctgatgcttttattttttatccatgatgctgctgctgttgttgttttggttgagtctctccctcgcacttccatccggcaaggtgcattgtcagcctactggttctttggttggtccaccattggtttctgtgattgcattctccattttgccctctcctcttcccctacccccccaccccctgcaccctgacacctgtttgtcccgctgctgtgccaacctgcagcgggggtgtcaggaagctggctttgctgtccccatgtgcctaaggctgttgatgttttccattcgcagacatgttgctggatgacactggtgaatgctcggctcggaaggaaggaggcaggcatgttaagatagttgtcagctttcaggaggaaatgaagtggaaggaggttagttggatccctttccctgctttgcctgtccctcccccaggtagaactacctagcttagtgatctaattgtaaaacctctatcaccttggagcctaaggtgatttggaaatactactaacccttctcttaactaaccataatcccttgcagcattctgacacaagtaaagtgtgcgaacggcatttccctttctcgtgtgcttgaaagtctaataaagaatactaaaaatggtcccacgtttcactttcatgtaattaactaaacactaacatccattggaaagggcctttctgaatgtaatatactcccaaagcacttcagaggcagctatgcacattcagcatgtaaggtacagaaataaactgaccacatgcagccgaccaagagcaccagttttatcggtcatcagtcaccaagagtacacatcttggtagacatcaagggatggagatgccaagccctgggagcatgcaggtggctgaaaatagagctagtggggcgtcctgactccccaaggctggggaatccgagttttcctagtacggtttctgttcacttccaaagtctaggaacttccagagtctataccactgccagagactattttgggatgggggctagagctgatattgaaagttgaattttagccagtgattaaaacccagtgatgctttgaatgactgtttctcgaataaatgtaaaaaggcctcatgagtcaccatttcaagttcccttgagttttttgtttgttatttcttagtatttctagccaacatgctattgtagtttcagacagctagggaacccacagaacaaagcgtctgcagccagacctttcttaggggattcagctttgcggctggcttgctagcctcactatagggggtaagctcagcattttggcacttccattagcgtcatctagccatgaaatatatagtagatagctccgttttcaaaacatagctagtaaagtgatggactgttaggggaaactcgttcttttttcttttctttatctttttttttttttttttttttttggaggcagagtctcactctgttgcccaggctggagtgcagtggtgcgatcttggctcactgcaacctctgcctcccaggttcaagcgattcttctgcctcagccttccaagtagctgggactataggtacctgccaccatgcccggctaatttttgtatttttagtagagatggggtttcaccatattggccaggctggtctcaaactcccgaccttgtgatccacctgcctcggcctcccaaagtgttgggattataggcgtgaaccaccacagccggctgggaaactcattcttacagtaaatgcaggttacaccttgtggattatttattctagtgattgtcaatatgaacacatagagcataccttttacaaaagtttacaagtcaccttcaaaagttatattattctgcatcactacagcatccaggtgaggttggttgaccagggattattatcctcattatacaattgagaaacccgagaccccaaacattacttatttgaagccaggggcaagtggtggggtcagatcatgtcactgcaagactgctgctcttttctctgctgattttgcttagccgccatatgacacctcccccacctccacccaaccacgctcctgactctgatccttatgagcatgtaaaaacccaatattatggcatgttctatcagcttttcttttatcactgtgatctggttagctgccactacgcaaagccctgtgaacagagatgcaaaagagttagaaaaagatgttttgagagtattcttcccagagttttactagttttctgagttgcacatgttttaagttttaacaagaataaaaacaataaatgttatttaaaaacaagatagaagaaaaaatagaaacacattttgtcctgacaatgtttaagatctagtaaggaggtaaacttgatatgcaaaaatatgacagaaatacctaaaactaaatataaattagtacagaatatatcattatataagttacgtacagaattgccgaagcaatttaagctctgagcctgatggggttaatcactgaaggcttcctggaagaggtgagtttataagcaaggtttgaaaagagagagatgctagacagatgtggagagagttccatacaaggaatatgtgatttatgccctgtctgacacatttacttagcaaaagtttccatattccagagaggaaatcctcttttcctgactcttggaccgctgttttagcagtaaagcagggaaaggtattaagactattacttccacctaagttatacctggttttaatacaaataggacttttattcccctctcaaaccattggcggagttctaaggcaacctgagtcctctgctgaactgagtcagaaaagatccacctgtttttcacctgtgtacatttccttacccttaggattccagaccacatctctttcttattggctgcattggagttagtggcaagacgaagtgggatgtgctcgatggggtggttagacggctgttcaaagtaagtgtttcaagacaacggctacagcatactacctaacatgggcatccgggcctggggaggaaaagagaggttgatgtcctgagcttggccatttctcagacctgtccccttccctacatgttaatgttgctggaacttgttccctggctctcaagggaatggaaggacaatggtaagtacagactggtcatcggccaaattcttgccgtctgccctttgcagtggtgggccagctagtgagtgtgatctgagcaactctttgatcctctcacagtgaactgctaatgtccaactctcttttcaccttagaattgtgtcttaggacatatgcttcggagtatgtaatctgtggccagggcttagacaccagatttctagccttcattttgggggatttgatctgattttcccggtatcctgtgccaacacttcagagtctttgatttgttttacgagtgacattaatgtctgatcgatggccaggctcaaggatgttgccatacttatttctctattctttttaatcacatcattagattgggtgtttgccatgggataaataactaatgagtaccagggtgaaccttgaaacacatggtgatttgaaggaagcttttggtacattttttctattgtcctgaagtaagtcaacaactataagggctcattaatcatattccctgagtagtaataatagtccacgttttttgtgccagacactatgccaagccccttatattatcccatttaaaggtgaagaaagtgagggtcaggttgggcactttttcaaggtcatggatctagaattagaccccgttggtccagtttagttggtctgacttcaaaacctaacttaactattatgttggttcaaaagtaattgcaccaccataattacttttgcaacaacctaatagtacactatagtttctttctaacagctagatccaggtagcctcatacagagaaaattctgttttttgactggagattggtccccatcctggtaagccagcctatagaaatgagaccagagaagacatatgaatggcttagatggaccgattctccgacctaggccaaaaacttatctctggtgatggacagttgggacatccttggattagaataacagtttgggctgaaaagagacacattggcatcatagtaagtgaggaaatgagaccatgcaaagcctgttactgggattccacctaagtcatcgtgcagtcacctcctagtacatggaccttagttctacatttactaacctaaaaccttttgttcactcaactaagagggaacactttccaaattaaacacacgttttccttctcaaagatctagagctgattttttctagcagtctgcattttaatctctttgtatgatctttgagccaaaagaaggggatggaagagagatttcctgtcaaaattactttttcgtgaattttccagcaccattcacaggccctgatgtcttcaagacttcagccgaacttaggaaaagcagcctagcttttccgtgcttggttcatccagactaaacgttcacaaccttgttaggggtttgttttttttcttccactgctaaccaaataaatctgtattttaagaggcctgtggtactcgggctttatccccttagaaagtcagtttttctccccctcatcccacagctcaatttcaactcagacatctgagaaagaagagaatatgatcataaatcacccagggaaaacatgagtcatgggcagattttagccacatctttgatggggtctttattttttattttttccaggaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaaggtaattgagcttgttgcagaagtcggagctttcaggaattgcagtgtttgttttgtgacttggcataggcacttgtggccccagttttgtttgtgcatgtatttgtgggctgcttgtctcccttctaccacagttactctatgcaagttgaaccgtcttttgctttttcaaccaccttaggaaacaaaatcattttagtttattgctgcaattatctaacaaaagatcccattagccttatgactctgagatgatggaatcttaataaccctgttgaaatagggctttactaatactgatgaattactcttgccagcaagctttggatgcagtcccgttctacagatgggaaaaccacgacttgcaataggctgtaggagtcactctgagcatcctgatgaaactgctgaagcttgtgcccacgcatgatgctgctagagcttccagtttctcattacctagtgatattaagccccaggccagtggattccttagaactccaggcccacaaagttcactgaggaaaaaaaaagcttcactgccatgcaattctgggaaactacatcgttatccccatttgtgtttaggggacaggagtgcactggtacatcaaaggctctgtcattcagtgtcctaactcctgctgttaaaaaggctgtttaatccagtctgtcccaaatgtatttgattgtaaaaccctatcatttcctatatgttatggaccacttgaatatagactttcataaatactgtactaggctcattcttttgtgttgtctcatttcttacttccctgaaaggcactgctcttgactgcagttttgcagttgtttgatgcaaggtgtatttcctggttggtagaatttccacaagcaccccaccattttccatcagcaggaattaagatcttgctctgcaggtggcaagtggtacatattgcttgagcctcacacagcctcctcctgctagcaagtgaaattccacaattgtgcctttggactaaaagtgacagaaacagactcaaaagtagctgtaacaaaaaaggaaatgtatgggctcatggccttgggcaatccaggggtacacctcaagcacagctggatccaggtggtcagacagtgaatcaggaccaggcctgcctcagctttgcccatcggctgtgcttatttattgagctctttgtacctggttgatgaaatggcccctggtagcccaattccttcttctagcttaggaacctgaaggaaagaggggtttttgggaaaatgtaacagataattcctagggatgactctggcccactataggtcaaatgcccatcactgaattggtcattatgaccagggagaggatttgtccgagcctgggcaccagcccatccatttgggttggtggaagagctggaccagtggaggagaattggtggagttgctggattggttccacttgaaccaccaggaatgagctccccatgggaaagaagagttctaccatgaggggaagcaggaaggagtatcagacccactggaacaatcatcctcgacaagaaccctttaaggagagccttttatgtcctgagttcaaattgcatttcatccctcctgccaagcatgcgttgttcacttgctggttttacctgtgagcattacaaaggactgaggagtaaaaggaatggcctattgctgagaccaggccaagcctctctagaaagtaacaagattacctgcctctagtggagcgtgccacccctctgcagaccctgatccatcgctgctgtcagcacgtcaagttttagcacctcaagggatcagctcaggtttatttttcagtgacacctgactcttctctttcctagagtacttaaaacttatgccttcaagacactaaaaaccactcaaggatttgagctgaaagagttgcctgagctgcagtgattcacttcagtggtaccaggggaagggggtttgactttgcatttcctcaagtgagctcttgtgcaaaatagtcacttcctgtggggtttatggcagaagaccgaaacagagcagtacatatatatacagagagggtgttctagtggttttttcctgtgtttattattattattaaatttagagaccctacactccatactttgcattgaggtttgagcaagtgtacactacatcaagctcagtagcaggaaaatcttaggcttgtccctagcagataagacatctgggggcctttgtcatgttcattctggaagagtcattgtacacttagatatagatgcattggggggatctgctagcagtgactgagtacgtagaaggaatatgctattataaaacagtacatactcttcagtttactttttattaattttgctggtttcttgagagtaccttttaacaatgacctgaggttctggacagctaaccttggatggatcttctcttagagacagtatccaaaagataccccttttgaagccaacaaccctgattaatgacattgtcccagataggaaaggagaaggataagtttccacttgatgttgttgaggaccaagagtcccagctaacaacatttcaggctaggtctgccagtattcacattccggaatcaaatgatcccgccttgcatttttcctccttttaaagataaaagtggtgttgccttcatggcacatcttagtgtggatagcagtggtacctggtatgtgggagggagcagggtgaagaggcaacctcagggttgtgacagacaggactcaggtttggtttgggcagatgccataggtatagtatactagaggggtgtgtgtgtgtgtgtgtgtgtgtgtgtgtgtgtgtgtgtgtgtgtagtaagtatagtaaatccagacaggcaaatagagcccagagcctcatgaattctgcagaggacagatagggactgagagccaaaatgttcaaggtgagtttgaatctgggaagttagccaagacaggagacagaagcacatggcgttgatgaacagggaggtgacttcctagagcagcagcactttgctctcagcctccagtgttcctgggtgtgcaggagtctcaggtgagtggactgccgaggagaggaatcacctcaggtcttggcagtcccagttaggcaagcacagagagctgccttttctacagggcttcagatgattcctgtctctctcaaatgcagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggtgaggaggtcattctgagtctgctgtattttttggccctttcaaaactgatgatatcaccactagcctgaagggaaagcagcatttcctatcaacaatccttgggtggttttagaaagccaagtgaaagaggtccagagggggctagcagaaaagaagttccatctgtggttaagctgatcgagctcatttatgatgctcagtgctggtagttctttaatgttatccacgatacatctgttgcaatttaccaagaatttatcatgtgcgtactgggtgttactgattttccaaagtaaaatattttgtggaacaacgataataacaccaataacaaaaataacaataataaaaataatagaagcccacatttatagactgtttgccccatcaccagcaaacaccttctcacagcaataccttcacgggagtagttgtcaccatccccattttacagagaaggaaacagaggcttgaagcagattggtcctgcacctaagaccactcagatggtactaagtggtagaactgaagctcaagtcaaagtcttggactctagagccctgtggccagcaaatagattggctcctgcttcacggtgagcaacggaaacctgtttgaatggagcctgacctggtcccagccgagagttggaaagtgctttctcagacctgttcatgcatgcattagtgagcattgatggataattcactctagctggccctatgcaaaggggccagagaatcaaaggtggattggaaatgactccttcgccttaaggatcacctagtgtgcttgaagatacaggttcctagacctcacttcttgatgacctatttcactaggttgtttgaggctgggtatctgcaccatctacaagttccccaagtaacttgatgtaggtgcaggacaagagagaagtacccagagctcttctgttgagagcctttgtgtgagttagggaacttctcctgggaccagtaagtgaaggctccgcaggcatggggagccacatgcctggggcccagagatcacggtgaagagggactaagagaactagccactttaaaaggtgggctttttctactgctaacaagacatattttgacttaaaatggaggcccagggtgggtgggtgctggtaggagatggagaagatgttaccccctgagcaagcaggctagcatctaagacaggccagtgtggtgaagacacagactggggcaggcacccaggtctgacccatgcccgctgcttacccgctgtgcactctcaggccaggcaccttatcataccatgcctcagcttctccttctgtaaaatggacgtaatcatagtactcaccttctaggttattgtgggactacagaagttcctgtgtgtaaggcccttaaagccctgcctggctctaagtgatgccagctatcattatgacagtaatggcaggcagccatcctaggttctctgccagctccttatcttgccgtttcagccttttccactgatgcaccattattcttcctcttccatttttgacatgcatcccttaccccaggcatgcagggctgtgttctagtccctgttgagccaatgccccacccgttctccaaggttaaatacaaagcttgccctttcagcaggacttccccaagcccggtgcatatagacttgtctccccaatgctgtgtgttgtgtctgccacagcactactcagcatgacttaagtgtgtgtctggctcctctgctgctctgatgtgtagagggcttctgtgtatgtagctctcaggctacacacataaagagcacagtgctgtgcttttaccccaggctcaaggtttccactcatcaggtgaatactggaagtcaggacccagtcctaactcatcccatgcccactctgcatcccctgaggaccaagccagtgccctgtaataggcaggcacccagaatgtgtttacagcgcagaatcatgaagggcctttctgcctccactggcctgggtgaggcaaaggccctgagcggtgtgtcttcactgagtgcattcacccacttgttctccttcggccttcctggccaccataggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatggtaaaggctggttctggacctcatagccccccgggagagagtgctgccagctgatggggcactgtgcacacaggtggcccggggccgttgtgggagtgaagctgtgcacacgcatagggttgggagtgggaggcagccagctgtccactggcctggaagcacagggccatgggcctctgtgaccaccttgttctctagcttggcttggaatcacagctttcttttcctttattttatccgcagcccttacataattggcacaatgaaccaggctacctcttcgactcccaacctgcagcttcaccataacttcaggtcagttttcccttcccttgtccagttaaacaatggaatcacaaagaagaaaagcaagaaggggcgggtagagatgcctgtgttgagtatgtgttgtatgctaggtattgttaagcatttttctcagcttaatccatttaattttaacttcagcctcaagtaattacattcaccactctcagtttaccaatggggaaactaaggcccagagacttaagtgacttgggtgaggtcacacactggtcagtggcagagtggaacttgcaatcaagtctctgcctctgagtcttgctgtcatagggtcaagggggcagctctggaagggactgcaggtgaccctgctgccctgcttgtttccagtggcgtctctctgtcccaagtgaacatgagcaatgacagcttttacctaaaatgtccccacctagctgggtctgtgggccctcgagtcccagctgctgtgactccctaccagcttgtcttccctgccccgctgccatagcaccacgctggtgctctctcatggccaggatgtgggaggggctgttcacctcggttgtgctagattgcattgctgcctgattgacatcaccaaacaccccttgccccatattgaatctcagttgactccacctctcctgcctgggcccttagaggtggatgtgaaggtgtctcctgggctaggacccccggctcatttccactggccattctatgggcatctctgagggagatctattgaaagtgggtctgtatgtaattaccagagaaatgttgactcctccagcacactgagagcatggctcacctctgcatttaggctgtcctggtcttgttcatgctttcccctaattatccctcaagtccatcgtcctcctctttccccctatcactgccccatcatcacccagcacaccattgccatcacctagctggtacgtctgcttgcagctttccccctgcactctgtagccaatcctctgcactgtggcagccagaccagagtgagcattctagagtacacatctgaccatagaactctcgtgcttaaagtccttcagtagctccagctccctatggcctgcaggatgaaatccagactccgttggttggcaggtcaagtatgaacttcagctacactaaacctctggtagtttccccaaacatccatgctatttcccatgcctttgcaaaggctgcagcatcaccccactcctgaccccaacaactgctcctgcctttccttatgttgctgcccattatctgtccagtctcagcccagacatcccctcctctaaggagccttccctgattcccttaggcttcatcatatttcatttctttctttgcctgtctgcctcctccaccagactgtgagctcctgggaaccaggacggtgtcttagtcatagtgatagttccatagcctagcaccgggcctgacatcaagcacaagaggcagtttgtctcagtggttagagcctagcctctggagccaggcttcttggttctcatcttagctcttcaattaactagctgtttgatcctggaaaagttacatgacctgtctgttcctcagcatttctgtccgtaaaacggaggtggagataatatctatgttagagggttggtatcaggaactgtgagttaatacatagttacaatgtttagaagagtgttcggtgcatagctaatccaatttgttgcattagcatatacaccttctgtttctaacgtgctttggttcctgaggtcagccatcatttggatcaccatcatcagcttgaaaagtgtttctgacttcctccagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggtgggtgggagactggggtcaggggggcgggctggcatcctcaggtgcccatcctctgggccctggccaggacagcactttgcaggcacagtcagcagaagctggactgtccataaagatagaaagtggggcagagggacagtcacagaccaggtagaccccaaattgctagtggtctgcagaagagagatgtgtccagcctggcccaatgtagaaactgctggctcactaaagagctcccacctcaaggttcccccaagctgaagctaccctctgggattggctttgcttgaaaaataaaattttatcagcatttctgaaagctggacatttagaacagagaaaaaagatcactaaccatcccaccatcttgacataattttaatttgagcttagtttttctgtccttgttcatatgtgtgtgtgtgtatatatatatatatatatatgtgtgtgtatatatatatatatatatatatatatatatatatatatatatatatgctttatgaagtggcaatcatagcatacatataacatgttccttttggccgggcatggtggctcatgcctgtaatctcagcactttgggaggccaaggcatatggatcacctcaagttaagagttcgaaaccagcctggccaacatggtgaaaccctgtctctactaaaaatacaaaaaattagctgggtgtggtggcatgcacctgtaatcccagctactcaggaggctgaggcaggagaatcgcttgaacccaggaggcggaggctgctgtgagccgagattgcgccattgcactccagcctggggaacagagtgagactccaaaaaaaaaaaaaaaaaaaatcctttttcatttagcactatctcatgagcattctttgttgctactcagttgttgtttttgtttttgtttttgtttttgttttttgagacagagttttgctcttgttgcccaggctggagtgcaatggtgtgatcttggctcactgcaacctctgcctcccaggttcaagtgattctcctgccttggcctcccaagtagctgggattacaggtgcccaccaccacacccagctaatttttttgtattttttagtagagaaggggtttcttcatgttggctaggctgatctcgaactcctgacctcaggtgttccaccggcctcggcctcccaaagtgctgggattacaggtgtgagccaccatgcccagccaattactcagttttaaaaattatttttaaaggctacaaaatgatcaaatgtagatgtaccctcatttgcttaactgtttctgttcttttggacttgcagtcatgggcttccattttttttttttttttttttttttttttttttttttttaggacggagtctcgctctgttgcccaggctggagtgcagtggcgcaatctcggctcactgcaagctctgcctcccaggttcacgccattctcctgcctcagcctcccgagtagctgggactacaggcacccaccaccacgcctggctagtttttttttttttttgtatttttagtagatacggtgtttcaccgtgttagccaggatggtctcgatctcctgaccttgtgatccacccgcctcagcctcccaaagtgctgggattataggcgtgagccactgcgcatgggcttccatttttaaaaatcaagattagtgatgccacagtgagcatcttccccataaagcctttcctggaggagggagacccccaggtggaatcagggatcagagtgtccttctctgtggccaccatccagggctagtatacctgcgttcaggcctcagccctgccatccctcagaacgtctagggtccctcctgtgaagggtgctcggaccatggcttcacctgatgccccatcacccatgcccatttgagtgctaatgtattttcactgtggtctccaggcccccggctcttcctgtcatgccccatcgatgtggacggctcgagagtgtggttcaccgacttgtggaactattccattatcccctatctcctggaagccgtcagagaaggactccaggtgagaagacacccctgctggcttccttgaagctgagggggactgttctggtgaccagatgagttgtctttatctcctcctccaggaatctgactgacatggggtgacaacccctcacctgggagttcatcagtgtagtccagtgtagggacacacctggctgcaagtcctggctcttccacccattagcattgtgaccccaggccagctggttagcctttctgtgcctcagagccctcattgatattctgccacaaagagtttgttgcaaggatgaaatggaagtgctcagcatcgtgagtgcctgagaagtagaaccatacacatgtgtagtacttcacagtttgcaaaatattctcctatctgccttttgggttaagccttggattagtcctggaacttggacagaaatttggttttttactccatttttaagagaaaaaatgaggctcaaagagaataaatgatgtgcttaaggttataaaagggaagcttgaaaggtctgggatttgaatccatgccttctgggtcaaattccaggttcttagccctgaggctggtggcattctttccctgacatcagcacccctaccctcttaggaacttcggggcccataaggctgccagttcctcctgcctgacagcagttggaaagcacaaattctttttatttttttttagacagagtcttgttctgtcacccagactggagtacagtggcacaatctcagctcactgcaacctccacctcctgggttcaagcagttctcgtgcctcagcctcccaagtagctgggattacaggcgtgtgctaccacacctggcttttttttttttttttttggattttagtagatacggtgtttcaccatgttggccaggctggtcttgaacttctggcctcaagcaattcacccaccttggcctcccaaagtactgggattacaggcatgagccactgtgcccagcccggaaagcaaaaattctttacttctcacttgacccagggtttaactggaagcttaccattaatttggaacttgggatagttttattgttgagcctggaggcagcctaagaagttctgtaggcttttaacactcacagttagtaatcagcagacatcacatgtggctgaataatccagaaaccagtttggtagccaggtttccaagagtttttttgtttccttggtactggacagtgggagacacaagatgctatcgtaggcctgtggagggtgcagggactggtgtgcacccacaggcacgtgtgtgacaaatgcaagttaatggctgcagtcagtgtttgtcatttctggtagggctgaactgaggagtattcaactattttctatctatgatttatagcagcaatgatggtcttcagaggcattcaggacaaagggagcttgaaaaggaaagtattttgcctcttgtgatatatttcactaaactggagcatacgcattgcaaattcaagtcagcatatttaataaagtgtattgtgaaagcaggaaaaaagcaagaaattaggcaacttttggccagcctaaaatcattggttagcagagctctatcaactgttgctttcatacaagaaggtatgaatgattttagatctttgcagtagaacctccctaggtaggtaaagtcactggcgtggataaattgaccataatttagtccttaatcaaatggttttgttaagaccacagacccaaacaaccactcagtcattcctattttgggaccagtggaagcatctcctacctgctggattcttgcagtctgtctcatttcagaagcttctctcctctgttctcattgatggcttccagggagtgtgatatgcccagcacctctgggaaacccaagctgcttaagaaaagtaaagagaattgcaggcagatgaggtggactgtttgcccctgattccacctcaccttctcccatttgcttcatctttgctctaaatgtggtcttctggtgtaggaaggggagtgaacctcagagtcactgggaagaactcacgggctctgctgaataaaggcctcccctgccctggaaggcattaaccaggaagcagggagcctgtctgtgctccagccttgcgctgcacttgagcaggcccctcactggttaacagtggttggcggtgccaaggccctgctcctttggacctgaacctaaaggaaggctttctgggcatggctggaaaggaactccccttcccacctaggagaggttgctgatggagctgatcatagaggatcattgggcgtccttcccaccatgggaaagtgaggccccagccatctggggcagggagcagagacatgctcccatctcaagactcactagttcagtgtgaggcaggaaaagtcatcactgctttgtgcttagaggtcatttgaaggttagtctttcaagagtgtggagctgcaaagggaggcggccagagtttgcatcccactaagtggctcaaaagtgagtcactatgccccaaacttgtgacctcgccatcctgatcagcccaggagactgtatagactgcggattcctgcggaagcttgctgtgttcttcatgcctctggttttgaaggaacatttggtgatgttttttgagggcctgctacttgacaggcaccattaggggcccgacgtgcatgatctcatttagttctgacagcccagtgagtctcttaacagatgaggaaactgaggctcacggacgttcttgccccgtaccatgtccactcagcagggtatggtggagtgcgtgttggtgcccaggactagctggccccttggctacttctgttattttcaggctatcctgaggacacccatcactccactgagaagccacaggtggcttggggaaccaaatactgaattttatagagtggagttctccctatgatttcatttgacaaaaggattcctttatttttaaaaaattaaaattccctactctcctttgtgttactttgagtccacacctactctagggtcacctgcccctcacctaacccgggtaagtggccatgaagtgagcacattgcagttcagagtgaggttctaggctgagaacaggtggagtccctagaatgggttctgacagggctaccgtgcaccaggagctgggatggagcgctgcccatggtagtatggatttggtgggaacgtaaggagacctgctgtcatcaggggatgaggatggcttccaggtagcccctcccacaggtacacccgtgccaggaggaaacatgatatcgccctctagtgagcataaggtagcactgcaagggcgtgtaagtgcagatgcacttgtggaactgcttggaggaccttcctgaatgtgcagccgatgcatccttctgtgatgtgcacaccctcccaggagccccctgcatcccacagtcagaaggctcacagtggcccaggttttagttttcaatgtctcagctccctgttgtcctgctcccatttttcctgacccagtggggatgccaggttccttctcctgccttagggaaagtgaatgtcctcccctctgtgtctgtctgtccagatgtctctgctgctgccctcggggcctgcagtggagctgaggagctttatgatgtttcctttgcttaccacagtacttacccagccattcatcacccagacttgaacatgtccagtgacaagtgaggaggcttgtaaaaatattttctgttcttgcagatgatgttaacatgtacctaatgtgcatttgtcttatgactcagtcctgagccctgcttccctttggagctgtcattggaaacacttgccaaagtgtctaaagtctgcagggtaactcaaaaggcctttctctgtgcccagggcaggcttggtgcctgcagggaacaggaacagtgcagagtcagtgtggggccatttatcggattatccagcctgctctgagaccccagacaggtctcccgtctcttggccttgggttctccatctataaattgacaagtttggactagaagagtgttttttcaggctggtttctatgaagcccaaaagttccccagtctactcagttgaggaccagagatgaagagcaaatgtttgaaaaccatggtgccagataatctctgaggacatgttcagctccaggagttctagcctctgtgattctgcagccctgagcatgtcctcatccaggctgtagagtggagacagaagcagtagctgtcacagaagcagtagctgtgagggtttggttcagcctcatgtgaggtctggcttgggaaatgcagcccagtttccacagggaaagacctcagagggagaaacttctcaaaattgcacaaatggttctaatgtggagcagccttcttctgctccaaatatcccacttttgcattctcttctgccctgagacacatgcccacatacacacaaactcatgcccctcacacgattccttcctgctcacacaataattgcttttcaaatgccagactgagctcctaggcctgagactcactcctgccccaggttaaggaagacttagcaacagactgggccagagcgcaggacgggaggagtgctggtgtctgggaaggcaatgagtcataggaggctgcatgacttaagcagagggggtgatagccacgaatacagagagatgggcccatctgagaaggggcagggtgggcagcttccctgacagaaatcatagctagaggtcccagatggcacagacagtcatgggagtatgggcactgctggcagggacaatgagcccagcaggctgtcacactgatatctggccaacagcctgctccgcgtctccctgctctgggtctggctgagtcacgtggctcacatgactcagagttgttcaaggtggtgtcagtcaggaggggtggagaggaaaaaggcctggcaaaggaagctgaggttctaggttcaaatcgggctctgcctgacagcctttctcagcgggctctgctcttcaggccttgattggcccatctggtaaatgagggggtggggctaggtggccccagctccttccccttggaaagacgtggttttgttggttcagagctcagcttcacactgttgtcagcaccttgctctctgtaccctctccacggcaggattcgcgggagggcagggagagcagacagacagacagacagccgtggccaccctagagacacactgcagccgtggtggcccacaggactctttagtctctgtgctctaaggccccctgcagagtcctctctgcagaactacaggtgacactgccctggctgtgagcatgtcctgccacatggaccaagtgggccaaactagtgggccgtggaattgaacatacttagtttccaattctggcttctctcctccctgggcctatttcctcatctgtaaatcacggatattagtacttcctcttggagttgcacggtggttaagcaaggtattcgtaaagcatttctcacggtacctggcacaaagtcagctggaagatgtggtggtgttaaaggagaaaaatataaagcctatacctagctgtgtaatatacagagcctcgtgttgggccagtctaggtttctgttcttcaaagaatgtatgtatttcttgaaattgctagtaatggtcactaaaatcattttaccattagataattgaggcttaagaaaaggagcttggaggcatggtgttgatcttaccataaaattaagtgataatatagtttactgttttaagagccaattagctattatggaattttgagaaatacatgacaagagagaagccctcataatttcactgcctatgtgcaacctctgttagcaatttgctgttttgaaaaggagtagcacttctatataggggctgtaagagtcagacccatttcaagaaacggggttttattgagccaggaccagcccagcacagtggctcacacctataatcccagacctttgggagaccaaggcacgaggattgtttgagcccagaagttcaagaccagcctgggcaatatagagagatcccatctcttaaaaaaaaatgttttaaaaattagccagacatggtggcacacaagtagtctcagctacttgggaggctgaggcaggagcatcacttgagcccgggagattgaggccacagggagcatgatcatgccactatactccagcctgagcaacattgcaaaaccttgtctcaatacaaaatcaaagtaaatattaagccagggccattgtgacctctgcctgcagtgttggtgcccagaacccaaggtatgtaggcagtattctttgggtagatgcaccaaatggagtactagagctggctcttgaaagctgatagcacctttttccaactccacatccagtgacatcatgtcagtggtttgaagtcagtcatggtgggattgtaccatggatgttggcaaatgcttcaaatcaggtcattgtttttccccaaaagccagtttttcaaattggattatcaaggctcagagtttagggtcacacggtgagtcagtggcagagctgagacatgaacctagatcagcctgactccaaagcctgtattctagaccactgggtcatgctgccttcagccttagcacctcgaactgtctgcatcttggatgacttcctgagcatggaatagaagtggaattactccatcagggaaggcatgatgctggatttggggagtttttcagaaagctgcaaaactggggctacgagagagatctgggccacttccagactgttccttctttgcctgttttcagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctggtgagtcctcagccaccagagcagctcagcattcctttagcacttactgtgtgttgggtatgatgcagagcctctggaaatacaaaggtgactaaatccagccttgctttggaaggctggacccaaatgactgggccatttttgccaatattttcttccatggttttagtttttcactaaaaacttctcctctgaaatttttttctggtattagataacagattaagaattgatttttccccttaaatgttcttatacctactgtctctatacaacactttgccctctgatttgggatgccacctctattacctactatcctattactttgatctctcctaccgatagcagagcagaggaagagattgctaaggaccagaagcccaaggcaaatgatagggtaaacagggagaggtctgagggcaggagggactcacagaggggaggaggcctgaatatgagtcccatggccattgagatgagctaagtctttcacactgtttaagcttcttatttattcggctgttgctaaaacaataaaggccctttaagaagcacccaggctggggtggctcacacctgtaatcccagcactttgagaggccaaggcgggtggatcgaggtcaggagatcgagaccatcctggctaacatggtgaaacaccgtctctactaaaaatataaaaatttagctgggcgtggtggcaggcacctgtagtcccagctactcgggaggctgaggcaggagaatggcgtgaacccgggaggtggagcttgcagtgagacgagatcgcgccactgcactccagcctgggcaacagagcaagactccgtctcaaaaaaaaaaaaaaaaaaaaaaaagcacccgggctgggtgtggtggctcatgcctgtagtcccagcacttttggtgggcagttacagcctgggcaacgtaacaaaacctcttctctacaaaaaatacaaaaattaactgggcatggtggcacatgcctatagtcccagctactcaggaggctgaggtgggaggagggcttgagcctgggaggcagagtttgcagtgagccaagattgtgccactgcactccagcctggttgatagaaccaaaccttgtctcaaacaaacaaaagaaacacccgggccaataacagtagtatttctaatcgattgtagtactctaccaatataagacccacacagagtcacactgctaaattagacctaacaaatcaaaagcccagtaaaataaaaaggaagcaaatataccaaaacctcccatggttaaaggactattatcatgccttaaatttagccccaagctttcttggcaggcatagcaaaaagaaaacataacagagaatattatttacattacctaatgaaagaaaatattataagagatgtagcaggattaaaagacaactgatttactgttctattcctagcagctaattaagtccctagattaaaaaaataataataatattaataggcgattcaggttgtctgccatcctactgtttggtgggatgtagctgtggttctgttgaagattgcagtgggaactgtattttttaaggatttattatttgtgttgccatgtacaacctagtttgcaatatttataacagtagtcttacaaaggaaagaagcatactttaaacagccgtttgcaacgttaaccattgctgaaagccaaagtcacggaggtattttttgcaggggcaaactcatgaggtcttaacttacatagaaaatagaatttagtatatttagaggaaagaatggccagcccatccctaaacaatcttttctgagccagtaacatttgtatcactggttggacacagaaggtgtgtaggtaagacccaggattcttggaaatgcagaaacagatttctccttccaaccccaggcccccagaagtgagctgtgccagtccagccacttccattaccgagttagatatttggtatttctcctcagttctgctctttctgcccagggccatatgtctctattatcatagctctcttctgtattaatccttctcactcatgagactgagacttccatgaaaacagaatttacttgcttttgttccagaaccatatactgtggacacactgggagtgtttaatgagtgaataagtaatcccagttgccaaggattgtccattatacttcagctctgcctcttccctagttatggctgtgcagatggacaccagatgatggtgcttctgcagcctggcgcatctgggtagactctgcaaagcatcctgaggggcagctggattgtatgcccagctgcaccacatcttggccctagctcagagaggccccatattcctgacttacttcctatatgaaatataaaatacatacacacaatttacagttataaataaaagtagtttttattccctctcccactcccaaacaagtgacccgtagtatgtaaacaagggcagattcaagaacactgtcgctaaactcttttaagttagatgatgatgacaacagatgacatttattaagcgcttactatatgccaggccagccccttttctaagggtttaatacacattatatcattttattccctacttcaaccctatgagaagtgttgccattctccccattccacagatgacgaactgctggctcagataccttaggtaacttgcccagagattcctgaatcataagcgaaggctctttgcactcggagcctttgcttgtaactggtgctccccctcacctccctgccaaggcttccacaggagctgcagcacagttggctccagtctgacctggccagagcaaggagaagagatgggtttgatgcttgttgaagtgggagggggtccatgtgcttccgatgtcagtgatgctgatgccaagttccaggaacagggatgctcagccacaccttcatccaggccgagggctaggcctgaaaggtgtgcccctcctaaataaaaaataaataagctatgtatagagatcatcattttgttttcagtgctctacgtatattaactcaatccacccataacattatagggcaggtactattattattcacatttgaccagtaaagaaacaagtataaagaggttaagtaatgtgttcaaagtcatgcagctagtaattggtgaagctgggatttgaaccctagaagcctggcccaaagtccatgttcttgtccactgcctccactgtgggctgttatcccaggtgagtctggaggaggtggcatgaccttttaggagtccagggtgggcggccaactagacagaaagcagctcatgcttctccactcttcccctagatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattcaga

SEQ ID NO: 190 - DNA, 45728 bp, Homo sapiens
tccggcccgcacccacccccaagaggggccttcagctttggggctcagaggcacgacctcctggggagggttaaaaggcagacgcccccccgccccccgcgcccccgcgccccgactccttcgccgcctccagcctctcgccagtgggaagcggggagcagccgcgcggccggagtccggaggcgaggggaggtcggccgcaacttccccggtccaccttaagaggacgatgtagccagctcgcagcgctgaccttagaaaaacaagtttgcgcaaagtggagcggggacccggcctctgggcagccccggcggcgcttccagtgccttccagccctcgcgggcggcgcaggtccgggcccggcagggacggggaggggcagagcgggaccggtcggggctggggaccagccgcgcgggcttctgaacgggcacgctgtcggagccggaggctcgtctagtcccgagccccagcgggccgcggcggctcgcggggccgccttcccgggacagcagccggggcccgggcgccggcgcgggggaggacgctgccctccccggccgggcgcgcagctcgcagccctcgctccctcccccggggcgcgcaggcgggcgctcgctcgcagagaaggtgccggcggggccggagccccgaagcctccccgggcggcgggaagacgggaggaggggaaagggaaggagggagggggtcgggctgccgggagggcgggggcagcggccgggactgcgggccgggagcgagcccagccgcccgcgccgtgtggagcccgggcggggcaggtgggcagcggcgggggcggctccgcgcggccgggctcggccgtgctgcccctcgcccctgctcgcgcggtcctctctcccgcgcggtctgtcggtctgcgcgccgcctcgctcctcgctcctcgctctccccctctttctccccctctcgcctctccgtgtctctggctctctgcctggctcccttgggtctgtttctctctcctgccgcctctctctggccgcccctggctttatttctcgcgcgcttggggtctctcccagtctccgtctctccatttctcctggggggcggggagggggggtctccaaaaaccgcggcggcggcggcggccgctccaggcgcccgttccggagtcggggggaggcccagccgggaggggggaagggggggagccttagtcatttccccgctccagcctgctcccgcccgagcgcgcactcacggccgctctccctcctcgctccgcagccgcggcccatggagcccgccggcccggcccccggccgcctcgggccgctgctctgcctgctgctcgccgcgtcctgcgcctggtcaggtaagcacccccccgctccccaccgctgcactccccaaactgcgggctcaggcctctcagactggcactgggaccccttcggctaatgccgagcagtaatagggggagagacgcctgtaaccagggttatagatgcagaaactgaggcccagagagggccagcgacatgcccaaggtcacacagccaagggtagaacccaagtctcttctatgagagtttgtctctgtggactctgactctgtgcactgtgctgggcactgagacaaaagagccgagttgcttcactcagcccctgcccggtccaatggggaaggctgactgacagtggctttcagagcagggccgtccggcttccccagaatctgtccccatggacatacgactttccacatgtttgacttcagggtgtgaggggaggaggtgagggcagaggtcctcccgatgctgcctggaatggaacagagacaagctgttgcaattagggaagagtgagccctccctctggtgcgcagagtaaaccggtgttagtgtgtgcctgggagagagggagccgggaggccgcggtaaccccagagcgagctgctgcgagcaacagatccttatgtaaaaacacggtggattgtccctgtggttgccaaagcctctccctggtggtcttgctccttgaggcgctcccagctcccccttcctcctgccttccccgagcttccaggcagctccctgcagttcaggtgctccgcggggatgttacctgtggctctgaccatgtctttctgttggcctacatcaaacacctggctgtcgccggcaggcgggctctgaaggctactgtgcatgttcaccaaagggtgaggtcaccattcaggagtcttgcttcttaaatgggttttgcaaaaccatgggtctcctgggagggcaccgggtggggggcggggggagcagagaaatggcattaagggagttgggagggagagaaaaatggggatcttgttttttgtcgtcttgaaactgtgttgtaggcagtggggtctctctgtacctcccacccttgaggagggaggtaaagatgagctcagtgtccaacacccccttttgcgtttgactagagatggtaaccatctgatagcagggagaaagggagaactagcaaagagtgggtggaaggagaagtatggggggtagacagctgcttctctctgccctgcagtttcccctgaaacccaggaattcacataggcatccccccaccccaccccaccctccacccccagttcttttcagttatagttgcgtccttgctgggctgaagggagcactgatacagttcacgtctctccagtgagtggcatctcctatctgctccttcctgcctgagctggccatttgtaccctgcaaaagtccgagttcctgccctgccatccttcctggcctggaaatgcacaagtgtcactcacaagtgcttaattttcctgaagcagggaattgggcccgagttaatttctaaatgtctattccagacccttctccgaccaggaggctgtggttcagtccctggcaaacgagcagtgacgctgattagcaagtgctccgatgggcagcctgcctttcctggggcaccggctgggaacaccaacacctttcttgtgagcacatctcccccttttgcctataaaaacagtctataagatggtaaagattgggccataaaacttccgttccaatccattcagcatcaatagcctgaaaaagtgggagcagcagaggggccaagattagctttgaaataaataaatcttaggaggtaagaatgaatttcttggtcgagggtggtggggaagggatgaggtgcgaccatcatagctcaagtctcccattatccttcagtatctgttcttcggggtcctggtcacaccatgggcctgggcagggaagtcacctggtttggctgaaggatggggcctcaggcccctccccctattgctccagacatggaatttacaacaaagaagtagagagacaggatatgagggtaggaaggtacaaggaggcagttgtccaattttctaagaaaatggatttgttcgagtgagaaactaaaatgtcaggtttaggaaggcggctttggattgaatgactactagtgtctcaggcagaactgtcagcctgggaggtgtcacatgattcctgtgtcttcacatgatcactgttttgggggggtggggccaatcatgtgaattatcctgggtgggggaggcaagagaagaagtttctaaagattgcttttagcacaaatgctgccaaagggaaattctaaaaagatcccagtgaagtcaccaacctatgtttttggacccaatgtgaggcctgtttcctaaaacaactgcactgagggagattctgaggctgggagaagggcaagggactgaggcctggggacacctggcacctgattttgtgtcagcagggcctgacgctgaacccgcaggatgcctgcttggccccaggtaggccttgagacctctgagtcaccccccaggccgacctcagataaactcccattcatttcttctctctggcctggaggaggccaagccaagttgcagttcaggctctggggagcagcggggccccccagtgaacctctcaccgtttggtagagggtggcactctgggggctcctctgtactttcctaaatggtaaagttaatctcacttcctctttcgtaagaagagaaaacggggcgggagtgctttggctcaacacatcaggctgttggaagttcctttaaagccatagttttctctgagtactttctggcctttaccaacccctcggaaactcacggtaattcacgtctgtacttgcagtcatgcagcacctatgcagtgctggtgtgaaccatgtgttgagagaagggaggaaaaccaacattcattagatagttaatggcgttccaggccggatgctgctcctgcgtcgtctcacccgcaagacatggattggctcttctccccattctgcagatgcagaaaatcgagtcccaaactggggaactaacttataagtgatagagaggagccaggattttggatgctggccttcctgctgggtggcttctagggaagaagctcaatgacttaatcaggatgatttagtccaagctggagagggagtgagagaggcccctttctggccttgggtggaggactgtagaagagttctttctctgggcagaaggttttgatgaagtcacaggcatttctctgaaagcctgctgagggtggaaatactgacagccccttggtcctcaccagtaacaacacatgagaggtgatgtggctcctgtgagagccccccatctgggctgctgagctctggagcccccagagctggaatattcctccctgcatcttcctggtgccctttgcgacagatggagagggggtgtgcgagaggaagggagtctaaaagtgttgtacggatcccacacgcgctcgcttgctgcttccaatggctccgtgcgacaggttattttcttatttgtagtcttggactgacggaaggtttcccccctctctctctctttttaaatgtgctcagatttctggcctgtcaacacaactcagatcatgtcactccccagctcaaaactgttgagtgggtccaagttttctttaaaaaaaaaaaacaaaaaaacacaaagctgccgtgaggcctgggcttcctccctgccaggcctgatttccagccacatgttttccaacaagctgacctgttgagatgctgcaggataaccaggcttcctccctgcagaccagagctttgctggctactcagccacacgagcaccccaaagaccctgagaagccctgcaatgtagaatcccgagctgggtcacatttactccagtgttccctgaacttatgaacgagaggcatttgatttgtagtatgcccgttagcatgtggcctctctccgtttggtaaacggttttctacagatccatgccctcagctgaactctcagctctgtgccttggcccgtgctgttcctgccatcagaaatgccctccctgtacctccttgtcttcctgtgtctgaatcctactcatcctccgaggttcaatttaatgtgcctcctggggagaggtcagaggagcctctccacgcagacacacaccctggcctagcgctaagatggtgctaagacccctgggtgttgatctgagccctgctactgacttggacaatttgcaggaatctgtgtctcattttgctcatctgtaaaagaggaatggtattaaccactctattgcaaggattaagttaattaatgcgtgtataatgctggaagccatgccttgtatgtagtaagcactcaatacatattaaccagtgttgtaattagcatggctttattctggtttgattcctcttttttaacaattgggacggattttcataaaacatctaacacagttgcttacacatagggggtacttaaaaaacagcaaaggctgttcagtgaacaaatgtccttcagcttgatattttccttgtagctttttttttttcttttttttttttttgagatggagtttcactcttgttgcccaggctggagtgcaatggcgtgatctcggctcaacgcaacctccgcctcctgggttcaagcgattctcctgcctcagcctcccgagtagctgggattacagggatgcgccaccatgcctggctgattttgtatttttagtagagacaaggtttctccgtgttggtcaggctggtctcgaactcctgaccccaggtgatccacctcccaaagtgctgggattacaggctgagccaccgcaccacccagctgtccttgtagcttttatgctgttgggggatggacaagttgagtagaaacccaggctagagtgatttaattgcctgttactagggactgagtgctgtgggcacagcctgcctctaggtgtctctatctggatccacaggtctgcagttgtggattcccggacctgcaaagcagtagggggcctgagagagccctctgtgctttcatccagtgccttatggtgcggccagaagaacagagagaaaaaaactggccgggcccacgcgggagatccatggcaaggcccggctggaacgccaagcctcctgtggtccaggccaaggcttttaaaaactgggctgtgctggaactttccactgtttcagccagaaatctgacaggatcccgaattccccgggaaaacactaaagtaatactaataggaaccatctgggttctctgcttcctgggctcagcacttggtgtgtgtgaccctggtggtactcacagccacctggcgatgcacgtcgttatcttcggacccgttggatctgtgaggaaactgaggctctgaatggtgaagcagcttgcccaaggccacaccgtaagcgccagatgtggataaccactgtcggcctaatcacagagcctatgtggttaactgttgtgccattccttagccgtcactgaggcttgcttgacaggtagggaaactgaggcccagttgtgctggcaccctgctcccttagtgctcctctcatttttgtttttgttttttcttcctttctttctttctttttttttttttttttttttttttgagacggagtcttgctctgtcgcccaggctggagtgcagtggtgcgacctcggctcactgcagcctctgcctcctgggtccaagcaattctcctatctcagcctccccagtagctaggactacaggcgcacaccgtcacgcccagctaatttttgtgtttttagtagagactgggtttcaccatattgatcaggctggtctcaaactcctgacctcaggtgatcctcccgcctcggcctcccaaagtgctgggattacaggcgtgagccactgcacccggcctcctctcgtatttctatcagtgcaccttcctatgaggtgggggcagtgtgtgtccccaaggtgtgtccctgtccccatactagagaaggaagcatctattttcacagctgaaactgctttcctgttaactgctggtgttcctgggatgggtattctgatgaagccctccacgagatggattttccctgccaggtgtcttgccaggccctcagtccagagagatgcaaaacagctgaggtggaagtcggaaatgctgcagaattggttctttgtgtctgtaagatttcctggcacattcgttcgggggcgcagggtgttagatggctgcagattagcgccaagagcccaaggagatcaggtgctcggatcaggagggaaattggaagccgggagtgagcgatgggcctcccagccaggagggacggctggagcaggtgggcggtgataccagcgccgtttctacagctccattcttcaggccgaccgtcggtgttctccagaaatggaagcccgtggtggaaggaaatactaggtacacgatgtgctcggcacaggctgagccttgaacatgtgttagctcttccttatctttttattttggaaaatttcaaacatatgcaaaatgagaaggaatgatgtaatgagcctcagctttgacactgatcaactctataccatgcttgtcccctgcccctatttttgctagggagaggagaatcggggagtatataaagcaagtgctaaacatggggtatcatttcacccaccgatactctctccacatcccttcatgtgagctgttacctgaccctcaccacgagccaaacagtatggcccttcatccccactttacagataaggcaactgaggcttcccaaggccaagtggggctcatccttaggccacacagccagtgagaggtaaagccaggctccactcctcactttacccttaaccactttgcagtcattattagggtcattttaattgtaaatattcattcaacaaatatttttgagcacctactatgtgccagggatggctctaggtgcttggaggatacaaatgtgaacaagacagacaaaaacacctgctctcgtgcagcagacattctagtgaggaagagaaaaacacacccaagtaaacaaatgatgccaggtagctggggagaaaagcaggaggagggaagggagaaggttagtcaggacagagggagggccgctctaaggagcagaggcctcaagaaaatgtacaattaaggccaggtgcggtggctcacgcctataatcccagcactttgggaggctgaggtgggcagatcacctgaggtcaggagtttgagaccagcctggccaacatggcgaaatcccatctccactaaaaatacaaaaattagccgggcatggtggcgtgcgcctggaatcccagctactctggaggctgcggcaggagaatcgcttgaccccaggaggcagaggttgcagtgagccgagattgcaccactgcactcccgcctgggtgacagagcaagactctgtctcaaaaaaaaaaaaaaaaaaaaagaaaagaaagaaaagaaaatggaggagtagccacgggggatagcaagagccctccatgtgggaggaatggcagatgcaaaggccctgaggcaggaatgagcttgtatgttccaggaattgcaaagaggccagtggggctggagtgaaagtagaagaggtgggggagtgagcagaggtcagggccagaccagcaggatctggctcattgagcacctaacatggagcatgtctggcttgtgagaggatcattatgcattctctcatttaattctcaccacgggttctgtaagatgggaaataccgttaatccattggacagatgaagaaactgagactcagaaaggtaaagtgacttgcctaaggtcacacagcttttatgtgcagaactaggatttaggtccctgaatgctgcagcatccccattgctgctttccgcagccgtccttgcccccttcgggctcttcacccatagcagctggagtgaatcaagtcatctttggttctgctggaaacctttttcggtttccagcatggcatttctggaccacgtctgtctcttcatcctcacctcttaccactctcctgcctccttgggcttcagccttggcagcgtcctttctggcccttcaccagcttctttcccacccgagggcctttgcactggctgtctcttctacgggagcatcttccctggtcttcacttcctttgggtctcagctgccacctcccttccttggatgctgtcccaaccaccccattccaaaagaggttatcgcttgtgattctctatcactgggccaaatctgcctgttgcctagtgctcctagccctttctatattaattcatttcattatttcagccctgtctcctccactaggatataagctgcacgagagatgggctatgtctcttactcactgttgggcctcccaggacctcagcacagggcctgacacacagtaggtgggttaatagatactgattgaatgaaagaacaaggtgggtactaaaatcccccttttaaagaggaggcttggagttatgaggttgtacgagcaaagcttattccctaactaccacagtcccccccctgcagccagggccgggatcataccacaattccctgcccatcaagctgtcatgaatagccctaagatatcaggaagcacaaagatatcaatgccaggagggataggaggaggcggccaagaaaccccggaatttgtacttaaaattctggctacgcaaactgcttgcccaactttagacaccatgatgaatgatcaggtgctgcaaccatgaaacatgacgtaattagtgctgcactcttggctgggggttggcttggaggccccacctcgaggttagcctcccccagagggtcactgcacgaggcagtctggtgcggggtgggggttacaacagagggaggtggaatcagaccactcggcagccctgtgaccatggccaaatggttgtacctcccaaagcttcacatctggtcctccgtgaaatgggggtggcgacagccctgtcttactgggctcctgcagaggttccatgaggcctgtcttgctctgggcagcgtcgatgcttattagctattgttactgctgttatgtgattgtcatcgttttatggtttgggaattttaaaagctccatcttttgccagcggggagacctggaacccactcctctgccccctcagcctcagtttccccttctgtgaccgggaggcttggctcggctcctctcttgcaggtcccttccagccctgatgctccagcctgcatgtcctcctggccctttgtcctgatgactccacagactcctctgggaggagaggccatggaggggcttctgctctggggcacattcctgaattggagtccagcatgtgccgcttactggctgtgtgctctggggcaggtgtcttcccagctctgagcctccgtttccccatctgcaaaatggaaccgctaacactgtttcctcccaaatgggtgactgttgagggttaaggaattaagagccgtggaaagtgcttttgcaagctgcaaaatgctctataaaaggaatcagtgaatagtgtcagcttggggaaaaatcccgtcagtccggagactgtctgctgccggcagtgtgctgaaaccctggcaaatgtcgtttaataaatgcgtgttgcttttaagagggcctttatctcagctgggaaaatgtgtgcgcatccttggcaacctgagaatccagaagcctgaactggaggggacctgtcacagggagaggcgatcgcatggggtggctccagcctccagtgttggaatcccacctctgccacttacctacctctccagactctgcttcctcatctgtaggaggggacagtgacaatagcacctgccactctgggccaggatgtcctgagggctaaatgaaggcttctggttatctggcctaacccatgcatttcccccatgaaagtgtggctgtgcagcaccagggcctgtctcagggcaatggttggggcctggagattgggaggacctcccaacctcagcctctccaggccttactccaggcctcagtttcttcctctgcaaaatgaggaggaggaaaggtccttaggttgtcaaggcaccaagcctagtagatgtcaatgtcctctacctgctctctcagcctctgccggtcccccgaagcctgttaattctaaaggatatttacacagatttgcagttcttttcctgccactttgcaaacagggtcacactgcaagcatcgcttcatcacctccaggtttcatctgaacccagcaaatgctccatagggctcccagtgccgcctgtccccgctgcctccttgccagcagtgtgctcagcctgcttacaggcccatgccagaggggcctcatgcatgcatcaaggcagagctggttctgcctcggagaggatcccgagcctctcaggcttaaggacgtggtcatctgtcgcccccttcatctttagacacccatctgcatggtgacagctgctctgcattgagtacttactctgtgccaggcacgctagcccgtttcatcctcagaacaaccctagtattgttatcatcatcatcatcatcagacccattctacagataaagagccagaggtccagagtgggcgagacattccctggagtctcatgggtagcagagttggaatccaaatcaaaacatactttcagccagtgccaggcactgctccaaccctggggaagaaaactcagttcctgctctcaaaggacttataagtgagtctatgacagggagatgagcgcttttaaaaaattaacaaggaaatgcgtagctttttgagtgaggatgacatatcgaacaatgaagcagagccagggacattgaggtgggtagtattttagacagaatggccaaggaaggcctctcagataggcctgaaggagaggagcgagccagacatgtagatatttagggatgagagtgccaggcagaggcaatggcgagtgcaaaggtcatgtggtgagtggagaatctggcacgattgggggaaagcaaggctgtaggcccctggggccactgtaaaaattctgggtttcactctgagtgcagtgggggctgtgggagggttttgcacaaaggaggaacgtcacctgacttaggttttagaggcttctctggctgctgggggaatgtggctggtagagaggtgaggcagaggcagggaggtcagcgtggaggttcagtcagggtggtaagaagaggtcagggtctggccatgtgttggaagttgagccagcaggatctactaacagatgggttgtggaacacggatgaaagggagtcaaggaaatgtctcattctgagtccagcacttctaaccacagagcctctgacctggggagggagggggctgcatttcctgtttacaggtgaggaaacaggcttagagaaaagcaactttgccaagcaccgtgctacagacaagacataaaggtcatctggccccagaacctgagctctggacagtcttagcaccttagaagtttacctactgcatggatggggccaccagagtctgccccttccctgcagggatgtggcacagcactgagttctcagagctacccagggcaagggtgaaggagtggggaccctgagcccctgggccagctgtcagcttatttaccaggccacacgcatccccatttttggtggcttcaatgcaggtagcagtttctatcacagcacctggtttgtccctgcccaatgggtgtatccagtggtgccggcagaatgttcccagtgctggcctgctcttcagatgggcaaccgaaaccatccttcagggcgctaggttagcccagtcccaggtcctccccatctcagcttccttacagccagtgagcatgttccaaggactctaccctgagtcctgtcacctctgcgtctttgctcatgtggttccctcctcttggaatgccttccttcatcccagcctctgtcagcctttaagacctagctcaggggccaccagctccaggaagtcttcctgggtttcactctcttccagaaccccatccctaaacctcctcttgcaacaccgatcgccatgtgcgtggtcattgctcatgtccaggacggccccacatgctaagatagtctcaagggcaagggcctgtcttacttggctctgttttctgtggtatctaggacagggcctggcagcagagtgaggtttgagagggcatgaatgaatcattctgactccagaggaaatcactgtgtagtcctggctgttggagccccaagctctcttcttgggaactgtggcatccatgcagccatccactggtgcagccccggccatgaatgcagccccagctacctttcgccttcctgcatggggtcatgggctccagcagatggttctgggctagcctgttgacagctgtgccctgtggccagcacatagtaagtaggtgctctggaaaggttagcacctcctatcaagggcacgaccctagacagataccacacagggtgttgaccgccaggagcccatggcagacttgagggaagtgtgtctcctcacatcctccatcacccttgtgcttgtggaaacttacacagcaacctcatctattccaggcacatgcccagctggacacactcccgaacacaggcacacggacacctggggtgcacacaaatagtggcatgtgcatacctccctgcttgtcaatgcacacaccctcatagtcacatttacgcatacagcactctgtcacacacgtgccaccccccacacacaccctctacacacacatacacaccacactcacgtgcatgccgctcctgcatcactctcccacacactcacaccctcccacacatgcccaggccaccatgattcagacactctcctgcacacaattcacatgcccacgcccatgatccctagccccccattcagacacagtcctgtgttgcactctgacatattccggcacacaggcaccgtctctttcacactcctccttgtgcccacccatgtgtacatgtgtgtgcagatgcttatgctctgtacacgcatacatgtatgtacacacgtgtgttctcgtgtgcatactcttatgcaccctcagcacactcatgttcacatgttccattgtacagccctgtactacatcctgtgtgcatccgctttaatgtacactcatgttcacgtgttctattgcacagccctgtactatatcctgtgtacatcctctttaatgcactcttaatgttcacatgttctctgcatagccctttattacatcctgtttgcatccgccttaatgcacatttatgttcacatgtgctattgcaaggtcctgtactacatcctgtgagcaccctctttaatgcacactcttgcactgcatactctggcacacagcattaaatcacacccagaagatagtagaggcagcccccgatgaggagctgctataagtgcggggtggaaaatcgcagccttctgaggatggtgaataacaataatgatgagggaagaagggagccgggtatcactgcagccactttagaatgttgagccctgtgtactgccagagctccagccatagcctcccagaccctgggggtccttgagtacaaacaaagaatctacaaagaatccaaacaggtggcctcctgcctgtccctgtggcttgtgctgtggtgacccactgcttccgggggatgggcaagctcccatgcagtggcagtgagcacccgcctgggcaaggctggttcttgggaaatgtgcctgttggcttccttctccccaccccttgagacaggcttctggaagactcacaccccagggtaaggcagccctccccatccccgcctcaagcttcagttctaagttgatttttttttctattagaaaaaacatccatgtgggcagggcgcagtggctcatgcctgtaatcccagcactttgggaggctgaggcgggcagatcgcctgaggtcaggagtttgagaccagcctggccaacatggtgaaactccatctctactaaaaatacaaaaattagccaggtgtggtggcaggcgcctgcaaccccagctacttgggaggctgaggcaggagaattgcttgaacccgggaggtggaggttgcagtgagccgagattgtgccattgcactccagcctgggtgatgagagtgagacttcgtctcaaaagaaaaaaaaagtatccatgctaatttttttcaccctttatgaaatattttcatcttttaatctcaaaagccacacacatgaacattgttttttaagaaatcaaatatattttctaaatcccagtggtcagttctcagcccccatcttattgcatctctcagtggcattcaatgcaggtggtcacaccctccttggccaattcaaagaagagaaaggagatgtggcgggagaagcaggtcacaggaaggggccgggagatgggatctaagatgccagcaggagcctcttgcccaggggggttaggtacattccagatgtaatcatttgagtgatttctttgaaatccatctttgcctcgagggtggaagctccatgaggccagggacacagccatttcacagcccttagctcagggcctggcacagggaaggatccagaatgcagcactgaccgcacttgctgtggacactgagttcctcttacagcaaacatatggtgaccacccactgtgctgactgctccccttaggaaacgtgttcgtgtgttttgtttcattactttttaacttttttccaaaaccaataaatgttcactgcaaaaaaatacaatatatgatgtattataaagtaataagaaaacatgccgaccccatcctacctcagtcccatttcccagatgcaacacaccacagcatgccatgtttaacttatcatccttgcagacctttttctctagacatgcgattgaccaatcaacaaagatttatcgagcgtctacactgtgccaaccacagtagcaggagctggggaaacagtgaacaaaacagactaaatccctggaggagaggttcatttaaacagtacacatacggtaacatacatcattacatgtacaggttttttaaaaaacaaaatgagatactataaatattcttttgtgttcatccaatttagagaagctgaaacaatgcccaaagtaggaggggaaaaaaagagaaaaacctcatgaggtttagattcatgatccaaagagagttacattttatagctttgtttaataccctccagttgtttatatatagttttattttacaaagtcatgatcatacagagggtatagatttttctccatctttttttttcttacaaaagaaatgcaaacagaaaacataaacaagagcaaaatcccatgtaaatctaccactcaatcatggctaatctttaatatcattgtttttttctaaaattgggagtttgggatcacactggatctactacttggtaacagactctgatcttgtaacacatttccattgtaattctataccatcattttcatggctatagacttggcctatagctgtgaaagtagattcaccataatgggatcagccaatctcctttccttggatattaggatattttcaattttttattttcatacagacacttaagtgaatgaagcaaaatgtctgcacatattcttagttacctaaaggtatgatgttagattgtttttcttcactcatatttttactacatcagaatgttgattacagttatctttgatggtatgatgtgagattattactttgtttccatacttattttctctaaatgccttgcaatgaacaggttttatttgcataaacacaatattatttaaaatgatgccatgaaaatttctatatgaccaccgttttcatggtaatggcttgttacggctgcctgtaattccacataggggataggccgtaattcacttaaccatcccctatcattgaccggctgggctttttctaatgtctttaagatcgttatacaggaaacctactccatatctggggttacgtcctcagggagcagcccagcaaaggctggtgaacagatttcacacctttggttcatcctgccaagctgctttcccgaaaagatgttccaatttcccctcccaccggcagtgcgtgggaatgcctgcccagccgccctcctctccctgagacggttcaggcccctggacagtcgcatcctctgctaggagggcaagagaaagcaggaaataatttggccagcaagtgaccccagacccagagccaggagtgatttttaacaagcctgattctcagaacagaacctgcagagaaaaagaaagcaagcaaggaaaaaaaaaaaaaaacccctctctactggaaaaaacatacacatacacagattaaaataatatttggcacttacgtcgcacttttaaaattcttcaaacgctttataaacactagctaattaattaagccgcctaaatctggctgcagtcggtggagagagctcgagaggagctaaaaaaaaaatgggggagccagcgctacacaactccagattttattgtcgcctgcctggggtgtgattacaggcctccggctgcaccacaagaatagccctgctccaacatgctgcacgcctgactccgcagcctctcctgcgcctcctgctccctcaccaactgctgactcacagccccttgtggtgttattgataaggataataataactgcaagccaggctgagtcccgggctccgggcctgcaccctcccctggatatgccagtatcaactccacctaacacatgaagagagaggagatttgcccagggtcatggagccaacgacatccttccttccttcattcattaccgcattcattctgcatatttttatcgatgacactgtgttttaggcaggaggttggaaacagtcccttgtggatcctacatcctactattgggaatgtgacaatccagagaaaatcaaatatgtgaataatacagctatgtgataataatgggaataagaattaaaacttacccagcacctatgcagcaggcataccaccgtgtcagggtcctcatgactgtgctggggtggatgccggaaccccacttcatggatgatggaatgggggtccagggaaggtgggtacagaggtggctaagaggggagccatgctgtcacccaggcctgctggccctagcaactgtgcttccccgaggcagcctttccagttggtccagtctcgaggctgaaatacagacctatccggaaagttcctagctcagtgctgctggtgctgcctctgatgtccccgcctggatgggcctcccgggcctcccacacatttggccaccagcctcacccctctcaggccgtctgatgctggctgggcctctgtccactgtgggttctgtctgtccactgtgggttctgtttttttctcctgtgccatgaagatcttgccatgttcaacttcaaatggaaatgaaatgagaagctggacttcctgataataaaagcagttgaggtcttaagtggttgatcaggaaaaggaagtcgaaatggtaatatttacacccaaagcaggtggagtggtcttaggcactctgagactccactcacctgccatgagaaccgggccccaagggtgatcccttgccagagtcaagactgggtgaggctgggaatgggagaaagaggcaggacaatgggcagatagccctgggcttcctgcagtgagggcagataggggtctgtgagcctctttccctggctgccctgcccctgccagtggggtggtgccaggccatgggttggtgggcaaattcacagggtctctctcctccccagccagagccagaggggcacagcagctctggacatctgccgcagccttgtctgatgtacaaggcaaaggtggcccaggtcagggcaggacaaggtcacatgaagggtcagtggagagcccaactggggccccaggtcacctgtcacctgcataccaggtagctgccactcctctgtctacctggttctctccttctcccctattctagctcgctctctcactctgcgtctgtctctcaggcatgtgtttctctgaggtctttatgatcatgatctttcttttttttgtttcttgtacctcaccttgttcagaatcgaggccctggctctgccttgctctgaactgttctcacttggtccctatccatcttcaacgcatctcatgacaagctcgtcctgccctcttcctgtctgggctccccccgtgcaccccaatctctccacccagggtccctgtcttgtgtgccccagtgtctctgattggggctcaggctcctgcagccaacctctacaattccttccagctgcccatttgggagcccttgaggcctggactgggtccagctccagtgtgtccccatcacagtgaggcctggatcacagggcatcagcaggtgttggtgagagtgaagtttgagccacagccacctccttgtttattcaatgtatagtaacaacaacttcctcagggcccatctcagggctaagtgacttctatgtgtgatctcgttttcttttcagaacaaagcagaggcctgggggctgttctacccatcctgtagataagaaaactgagactcaaaactgatggataaattaaggtcccacaagaacaaggggcgagccaggtttcaaaccaggtccgatgactctaaagaccagatgctgcatttggacgctgtccccagccttggcttattttatcctcccagagatccatcgaggtggggtcatagtaactattttacagatgaagaaaccaaggctgagagcagtaagggcaaactaagggcagctcttgcatttgtgtgacactttgctagccaggctcagtcctgggttccaggtggggactcaaacacactggcacgagtctacattggatattcttggttacctgagtggtggcccaaggacacagctataggccactgatccagaactcaaactacattctcctactgcccaaaccgctgagtacagcctcccttctcggggcctgcatcctgggccaggccagaaacagaatcttaacaccttgtacagccccagatatgccaggcccctacctctgagtctttgcccaggctgttccctctgtctggaataccaggctcccttctggctcattcagattagaattagcccagctcagatgtgactcttccagagagggtccaggcattcaaacccactctctgccatgtcatttagctttctgtgcctcagtgtccccacttagaatacaggctcatgttgcaggtttgttgtgagggtcaaatgagatgatacatgcactatactgatctcacagcctgcttctggtgtgcatccagtcaatgaacgtcattgataaacacttgaggaaacacagaggatcacgtaaggatgaaaaaatgactgctttgtgctcctttccaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcggtgagtacagcgtgggcctcctttgcctctggtttgtgacagtaactcaataataacaccctccattctttgagcaatgatcaggtgtggtggtaggtgctcctttccatgaattgatgtctcccccttttacaaataagggaagttgaggcctgaagacgtcatgctatttgctgaaggctccacagctggtaaagggtgggaacatctgcatccttcatctgcctggctgtgtagccctggcctcttcaaagctgacccagccctttcattccacagatgaggaaactgacagatagtgtgacttgcccaggcacaggaccagacctcacctgctgcctccagagagcacttccctctcagggcagccgagtctcctctatgtgacaggcactcactgagaacctactgtgtgccaggctccgccaagcttgtgttctcatcccttccaataagagatccacccagggcagggagcagagagggtgtgtttcctttatttcatcaccaaacaccaactgagaagattcctaaaaggcacagatttactgtttaatctgatggccctggtgagaggagaagccagagggttgggcattttctgtgggtcttttagaaaaacacttgtgtgatttagggactgattcatgcgtcactaaaggctctgaacaaagctgggtcatcatagaatgtctctcaccccagggaggaggtctcccttctaggtgactttgggttcctccgttaaggcagcaaagatgctcattttgtatttactgccagagccccaggatccttgttctaactccgaatcctgggacattagtacaggaaggaccctcagaccatccagcccaacccctagttacaggtggaaacttgaagtcaggagatgacaggggccttgtccacagtcataggcccagttagtgacaggatctggaccagagcccacatctgattccagggaggctccttcattagccattgtttacatagaagagcctggtgcatcataggtgccgactgaaagctccttgaacagaactgctaagcaggaagccagcacttctcctttccatcagtttcctaaaggttcagaatattcacattcagaccgttaggcccactggtgattggaaaaccgctcccaaatgtaagccatatcatttgatactgagatttcatatcaggatagagacctgctccattgtgtaatagctacagaatactccagcttatggaaataccagatttattttaccatcttccattgatggatacgtaacttgtccccaaacttgaactattaaaacagtcctgcagtggatgaccttatacatgtgtgaccttactcaggtgggagacgcccactgcaagtgccattgctagatcagagggggtgtgtgttttaatgtgtgtggatatggcctaatttccctcctagacattataacaatcaagtctccccacaaccgctggacataggcagggagggtggctttatcctgattgtgcagatgttacaggaaaagacgttgaagttcccagatgatgcatctcgtgcctagacaatcacagcaaatacgtggctcaggtgtgacccagatctgctgactcctagcagagtgctcactcctctttgccatgctgtcagcctaaatgatgccctggatgagaaaggagggaggtgggagggggccagggagcagcagctggattggatcctcatcctggcactttctccttttataacaagtacttatgaaggaagagccatttcttgccccctttacagataaggactctgaggctcagagaggagacctgtgtggtgagccagtgggggagccaaggtttgatccccaccagcctgactcacagcccctgtctctgtaacactcagctatgcttgtcaaagtgtggagaaatgctccaccctactcattccaaactcttgcagttctatagcaataagcataggctgaggcaggagaatgcttgaacccaggagacggagattacagtgagccgagatcgcaccactgtactccagcctgggtgatagagcaagattctgtcttgaaagaaaaaacaaaacaagtcctatgggagtaggagggactggcccccatcagaaaggtcctgcagatgtctcatgatatgggaacttgttcctaaaggacaggtctcagcacatcactgagtagcatccatggagcagagttgggcctcctgcagcccagcagaccacgtgcccacctactcacggtgctgaggactaaggatgaggagatgaggcatttcctggtgggtgcttggggctcattggagcaagagtttatattatcccctcaggctgtcaggagcccactgacttcagtttatggctatagggtaaccagatctgggtaccctggagggaggcttctccctagaactgcatgaagtcagggatctcaaagggaaaaagggaaggtggtggtcagtgtcagggttcatgaagttcaggcacttgctcaattgattgacatgagagcttggggaacactggaaatgcccattgggtacatgagggatgaggagacagtgccttcgcttttctcagcctcagtttcctcatctgtagaatggtgataatcagggactcctttggcagagtggaaaggatttgagttcctgtgtataaaacacccaatgcagagtagacacccccaaatcaaggttttttgtttgtttgtttgttttttctttttttttgagatggagtttcactcttgttgcccaggctggagtgcaatggcaccatctcggctcactgcaacctccacctcctgggttcaagcgattctgcttcaacctcccaagtagctgggattacaggggcacccaccaccacaccagctttttttttttttttttttttttgtatttttagtagagacatggtttcatcatgttggcccggctggtcccaaactcctgacctcaggtgatccccccacctcggcctcccaaagtgctgggattacaggtgtgagccactgcgccctgccatcaaggtgttattttaagatgtgttaccttgggcaacccagttccccttgctgagcctcagtttccccatgcgtagaacgtcgataattgtaccaacctttccaggatgttatgaggatgcaatgagcctggggcgacgatagaccttagtaagcaatggggttttcccaaggtcatgtgatcttgggcaaatcctggcttcccttgagtcctcagcttccctgtctatgaaatgatgatgatgattgccaaccctcacaggttctgtgaggattggagaggatgtacagagcctcggaatggtggcggtgttcgggttatcactgagctcctgcagaagtgtggttaggagagtgtggccagagtccaactgcctgggccacatcccagctctgccacctcctggctctgtgacctgggacaaggcactccaccaccatgggcctcagtgtcctcacttgtcagtgataacaccaacctcacagaccaggagttgggaccgaatgagttaaatcctgtagcgtgcttagggcagcaggcgcctggcctgcagtcaatgttcaacagatgtgagctgtgtgatgctgaagccatgcaacctcagatgggttagtgctcctccaggcctcaaggataaatggtccttaggatgtactcaggtagttttcaatcttggctgctctttaggatcatctgggaaacattgaaataaatcccaggctccaccacagaaatgcctcttcaattggcctggcatgggcctaggcatctaaagtttttaattaatccagaagattctaatacagagtcaggactgaaaacccctgggatagacacccagaggtcacggaggacaagttggaaaagatggtcctcttggggtgccagatgggagaacagcttttcagggtgtggatgcttctgaacaacgtgcacccgggacagctctttggaggccccagtggcctggccagaccccctcttatgatacaggcctcgggggccaaggtaggggccccagacaaagccctgctcagatccagcctcagtgtggggaaaccttccatcctgaaaatgtttttgtctaaatgaccgccggaatcccagcaaatccttccaattcggccccagaaccctccctgcctcgacacaccaagatgtcacggaggagtctgttccctcctcctttaaaatgcttccagcttctgtaaatggctcttctggagggaggcgcctgtgatcttgtgttttgaaagccaattcgccaaacttgtttcctgaggggattgtttagaaaaggggagagaatcctcacttggtggtttctgctccttgtatcatttgggtttgtcatgagccacagggagcagggtttgagccttttcttggtgtttctgctctgctttgttctgctgcctgaaggataaatgtgtagattcggaagcagtaatgaccagacctcctgataacagtcacaggggtcatttattaagcacctgctgcataccaggctctgtgcttgcattcatcctccctcttcttaacagggtggggtttgtatccacttttggccctgggcctctctgagctttgtcctaaaaggggctcacacgaggatcccctcacagagatggagtgaggattaaagagctgacgggcatggagggagcagccagtgtccagctccagagaagccctggataaatgggaactgattgcagcccctcagccctgtggggacatccaggccgctggcctcaatgacttgacttcttcaagtgacaccctccttactgtgccctcaaaatgtttgatgggtgtgagggagaagttaatatttacaaatgcaagtatgtgtgatatgtgcttcctggtgactgcgataggaggtatggggtaatgattagcaatttggagacacgtttacgacccatctgcagggagaaacagcccgcgttctgattcagccatgtgtgtgctttcaggacccaggaagtgcttctgcctgcttgggcgccctgtgtctgtgtaattaattgataattaaccactttggctttctccacacttggtgatctttagtgtctatctaaaactgacaccaaagaagaccgcagattcagaaaagtatcccttcctttcaaatttagcacttggcacagattagaccctgctggaatatttgtggagaaaatgaaaaatatgaagtaaattcataaatacctgaagagagagctttggatatgaataaagtctgggttaaagttagatctgtttttgcttatttttgtgaagcatcttctgtgtttatccaaagcaaaactgcttctgttgcctcatttaatcctcgctgcatcccagaaaggagaaatgctgctgttccattttacagacaaggagctgggtgtgccaggccgcccctctcatgggctgagcggcctggttccagctctcatggtgatgccacgttgctgcttactccctgcactgacctctataaacgctctctctgaggttggcactgttgccaggggaggcagggtagaaacagttaataccaaggatgagatggatcgttaattttgatcctgtgcccaaattgctggaagtcaccctgtgtggagtggagaagtttgaactcaggcctggacttccctctgggccctgcccctacactgtctgacctcacatgggtcctcacctctcccaacctttgcatcctgctctgtaaaatgacaataaggacaccgccctcattaatccttccacattattggaaggataaaaaataatgtctcagaaggttcttaacgtgtcacacacttatcgttagtgattgtcatctgagtcatgtctcctgattatcgatggtccttttgtagccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgaggtagaagaccctcacccagcccaagcccacacctgaccgccaagcccaccccccaccaccctccactcatccagctctactcttgctccagggcttgaaatgcctggaacctaaattcctaactgcccacctcccatgcccctagatgtgccagccacttactaacattttaatggcagtggctgggtgaccacaccacccaccaggtgccaaggactgtgctagccgtttcatttatttcactgatagcaaacacagttaatgagtacctactatgaactaagcctctatgtgcttggtgattttctttattttgctacagttacaacattccaactgcatgccaggggtggtgcttatagatttccctcattcttagcctagtaggagctaccagtccttgagcacctactgtgtgctgggcgttgtgcttagtaatttcattcatatgcaaagagcaccctcaatgtctgagcacctgatgcctgcctagctctgtcctggtgatgacctcaccgtggtgggggagctacgttatggagccctccctgtgatctgtctgtgccacaaggtcagagcttctgccctgtgctgtttcagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctggtgaggcctctatttcagctgacccagcttttttaaacttttagttttgtgggttttttaaatgttaaaagtagtaattcatgcttattatagaacaatctagaagtctataaatataaagtagaattttaatgtcagctccatttccccaaatcccacactccaagagtcaccactggtaagagtttgatgcacatcttgatagatcttttgacatagatttatatcacaggaggaaagagggagagagggggcccatctgttcatggtgtcctgcctcttgccttcttcacctgacagttgtcatgctccccattcctcactggcccagcccctcttccctactctttctagcccctgcctcatctccctggctgccattgggagcctgccccactggaagccagggtggagtcattcagggtgtttgcagcttgtctcacatacagtcagtgcttcagtgaacatccttgtgcatgttccatcccacatgtgactatttctgtgtgattgcccaaggaacactttaggccaaaatgcatactcatgtaaggaggagataatgctgtcgctcccctgagagagtgtgagggtgtcaaggtatcattttctcagcccttgcaacgtggtgttggtgtacatctcttttgttttcaaatggtggcacctgattggcatttcagtgcagccatggaatatttcatcacctgttatcaatgtggctgatgccctgtacatagtagaacccttgaatggattagaatggaagccatttctgtccttcatgcacccttcagggaagctctcaaagacagccttggggctgtgtcaaagtggccctttggtttcaccaatgccaggttttcttaggatgtgtagggcatcggccaatgctgggttttcatagtacgtgtggagcattggccaatgccgggttttcctaggacgtgtagggcatcggccaatgccaggttttcatgggatgtgtagggcattgggcaatgctaggttttcatgggatgtgtagggcattgggcaatgccaggttttcatgggatgtgtagggcattgggagacaggatgtgtggctttccacgccagctatgttgcatacttggctgtgtgaccttggacaagtcagtgcctctctctgggcctccacttgcttctggctgtgttgaaggggatgagcttcatgacccctcagctctgagtctcagctggtaggggccatgattatcttgctcagcattgtagcttcagggcctgaccacagtaagcactcagtaaatgctttttgagtgaaagaggataaaagagtcagttggttggctggttggttggttggttggttggttggttggttggttggttggttacataatccttagttagccaatgaggtagagatgactgttggccccagtaacagaagaagcagccagggtttggagggaggcttaactgacttgtccagggtcacacagctacttagtagcatagatttgaaagcacttttctgtggcttagagccctgcttctgatgaaccactgtgttctagtctatgacccccttacctgtgctgtgggcagtcaagcctccattgtattttcaagagtcctggttcagagcccctatgctaactcctgagcccagtgtgcatggcccaggtgctgggcacagaccggtcgtcagcccctgagctgtgcagagcctgctggccgcactgcccttcttccagctgctgattcagtttccagtggatctggggtgccctcatgaccgctctgtggttcactccagatgagaaggaacgtttctgttcctcaggagtgagatttctgcctgtatcctgcagcaggggttcctccgtagctgtcagctacaaatatattcccccctggcacctcagcatggtttttgtgctgttcatggatgagtctcgtgggcaagtgtgtacagacccatgagtgtgcccatgtggctcgagacatctaagaaggtccagccagatgttctcagttaatgatgcctgcttagtggtgaaaagcagtggtgggtttggttttctgtttttaatctgcatacgtgaagcctctattccatgtggtccctagagaacactggatctaatgaacggaacatctatattgtggtgggtgtggtgtgcaccttgctggtggccctactgatggcggccctctacctcgtccgaatcagacagaagaaaggtgggtgcattcccctcttcctccctaagggtttgtccctggactgtcctcggagggagacgccattaggtgctttgggttaaggacatcagcttctgccagtagcaagaagtccagaggtagtggtgctagggctggggcagtggcctcaccatgttagagtctgggtgggtcactctgtggcttccccctcatggttacaagatgttcatcactgccccaggccccgtgtcctcaaggggccactactgagcaagggagctgccagcctgggaagagaggaggcagggactcttcttacctgtctcagggaggacatcgtctttcccaggagcctcccggcagacttctgctttcctggtacaagtctaggttacatgaccagtccctggacaggaggccagagggaatggagataatagcgccaccatttgattgggaggacttaacaagtgattgcatgggaaatgttagggaagtaacctggcacacaagtgctcaatgtatgtcagccctgattattacccgtattgtatgtgagcccagaaatatgagccacctccctagaaagccccctcacagggcaaggtgcatagcctttgactgcacagcaggagggcacagggtcaaacccaggacaccgcttccccttgtttgtgtgcacgtgttacgtgtgtgtctgtgtgtgtgtgctggttgttgggagggttggttgttgctgtggcagggcctctgactttgaagtcagacaaaccagggttccagaccctggttatatactgtaaacaatcaatttggcctctacaagcctcagtttccccatctgtaaaatgggtttagcaacgcctgtcttggagaagttacaagatccaaataagcccatgtgaaataacgggtctgacacattctaggatcgccataaatacatgttctctttcccactcttggagaagacaattttaagctggtatttctgcaacctttttttattacaagagatagaaatacatttcacatctcaacccaacacatacacacaccctttgtatataaaattaaaactgatattttcttttttgtcatattcttttttctgtttaaaatgctggttgtgacccaccgcctccaaagggacaagtgctgtcccgagctgcctttctgtggcctggcacagctgagcttggttgggcacattgtacactaatcacgcatcccttcagtagctccttcacctctgcctcccaagtttccctccctcctgggctggctctgagatactggccaagcctgatgcttctgtctgggagggttggagtcaggccctgcttctccagaatctgcaagacgtcccaccaagacgtctacccaatgggttccctaaagttcctggagagccccacacagggaggactcctccttggatggggaagcaggtcccttccccaccaagggtgacagcccatcccatgggatgaagcattcatagcagccgatagtgaaatcctggccatcctttctgagtctcaggcccaggcagcacgccagctcctggcacacgtgagctcattactgtgggcttaggtgttgcagaggaatggagtttgcagggctgcagctctggtaaaggccacccagcccgagtggcaggtctgtgtgcagagcctagctctcaaacacaggctccagtgacagggacggctagtatcccccagcagttccaatgtgccaggcactgctcactgtgctttccctgtagtaacagtcagtgctcaccacagacctcatgggtgacattactaaccccactttacagatgaggaaactgaggcatgggaaagttataaaacttgttcagggcctcacagccaggaggtggtggggccagaatttaaacccaaggaccatgtctaggaccaccttgcacactacctccctccgccataactagaccccccttctccctcattaggccctggaggggtctgcccagcctctcaatgctcacagtgaaatgtcctgatttcaactcaaccactacccagctgtgtgaccctgaggagtcacctagtctctctggtgtaaaagggggtgactggtgtcctatcactggattcccagagatgacttgtgtccagcactttgcaacctgtcagcctccactcagactttcggtgctgagcacagcttccaactggtacacctcatctaaagatccaggacctgcccaggcagcaagcgttaacccagcagcaagaattcttgcactgtggcagcctccagcctattaaagtgcggtgcagagtgcatttgggtgtgcatgttgctttttaattacaattttacagcaaaatgggagtcaaacggctgctgaaccctggaggcttctctgtgggttaccccatatcacaggtttaaaacctctgaaccagatggacactttctttccttccaagatcctttttttggaaagtggtggcatgtaaataaatggatgctcagcccaaccctgcaagttatagaagctgagagagaggaagtgacccacccggggtcacatggtgagtgagtgggtagcagacccggggttcacacatgatccccgatttgcagccctgctagaatctgttttcaagccacgaagggcactgattgggacctaggcttgttggagggtctccgctgaggtttgtggttgaatggaggtgagacccagacagaggtagggcggttgtcgcctcccaggctgaaggctgcttttggacccctggcaacttccagaagtggaaaagcaggaccatctagcttactccttcccaggcttccttggtggaagaggatgcccactgggtgggcatgggggtctcctgtggttccaaggatgtgattacagcatttcctctccatgtccctggaggcaaaccttttgccaaaaaatagttacataagaaaagtgtgcttctagttaaacaactggcttttgtttcttttgtctttcagcccagggctccacttcttctacaaggtaagtgcatcattggtccagaccctcttgcagttattatttggttatttgacagccccccagactacaaagcataatccatgtccactgacctcaccaatgtgttggtcaacatgtctctttctctcctttgtaacctcctcacactgggtcacgctgtttttaattattgtcccaaatgaggggtttttttggtgcacagaggtgctaatttcttgcctgctcttcccagacaacgagacccttgtctaatcccatgtggactggggcagagacctcccgggctttctgtcctcacagacatcctgcacacgccaccggatgcatcctcccagatccaagttgtatactttactctttcctttgtttagtaaatatttattgagtaccttggcgtgctgtgaccctggaatgccgggatgagtaggatagaatctgtgccctctgcaagctcacagcctggtcagaggctcagacggtgacattacatcactgatgtacgtcaccgatggcactttagtttgttgattcacatttttagtgacttgagtccctactatgtgccagccctgctcaggaccagctggtgatatagcagtaaacaagaatcagcccaggctttcatggggctcagacgccggtgagagaaacaggcataaacgcagaaataaagtgattcatggtgtcatatcaggtggtgacaactcctaccctgcaaggagatggaggtgaatggtggggggctgtcttaggcagaggaagggactgcctctgaaaaggggatgcaaacgggtgcctgaaactagtgagctatgttggacaggagcatgctgggccagagaggaggcctgtgtgctgggccagagggaaggagaggaagaagataaggtcaggaagacccaggtcctcggcatcccggtgtcctttgcagatgcccctgcagtcagaggtgttacgaactattctgtgaaaagcctttatcggctttttggaaggcctctgatcttcatccccagcagagcagaggcagcacaccatcatctgccatgtgaacccatctgcatagaaccatgtggacatccgtgctaagagtgataaataaaactataaatagcttcatgttggttcacaccaggttttgccagcaactgcatagtgccaatcttttgatggtttagagctttctgggtttcagaattacagaataggacatgatgatctggagtggggcctgtgggtgttagaaggactcgggattttatccgcagtgggatgaggaaccaaaagatggacacgatctgacttttgttttaaaagtgtcgcctggctacatgtggagcccagactacaggaggtgaggatgtgtaggtgaccatagcggtactggtccaagcagaaaaagatggtgacctggaccaaagtggtgggatgggctgagaagtgctcagattctggatatattttgaaggtagacacaagaggacttgctgatagattggctgtagggttaaggaccacctcaaggttgggggcagtggagtgctgtatcctgagttggggggtgcaggtgatgggtggagtgatggggcaaatatcaggcaaagcagttgcatatagcaggagcagctcttctgccagagaaggctctgggaagcatcaggtgccccgctcctgcccagcagtgtgagtccaaggtactcttgggataaagccttgcttcttgctctgatctccacagggggcctcctggtctgagccctgcccagcctcctggccttttcctcccctgaacaagcagagccgcctctccagcaaaactaggctcttcactgccttctgggcacatgtgttttccttttgtcatgcttgtgcctgtcacactcccacacctaggtcactcttccaagggcaagactcgtttatatcctttgccaaaaaaccttcagtggctctacctgtccctccagataaagtccagatgcccccctgaggctcctgggccccttgtggtccagttgccttgaacagtttcacttctagccaccccctgtcctcacatttcacggctcaaccacactgtgctccccccttccctcctcccacagtctgccctcctcccccttgcacactgccctcactgctggggtgtgctccctgcccctgctcatgcactacccagggtcccccagctccaggggtggcaggcacagtgggctctgtgaatggcaccccctggagttatgcaatgtggtagctagagtgggacccctcctgtcacctgctcacctcctgcttctcctgagatcagcaagggcacgacatcctccagggtcggagggcttcctgtgaaccctcctggtgccgcagcgtggacaccctggtgtgttcaaggtgtctctgcacctgtcccatttcataacccacccctcaaggccagggccaatgtccctgaggttcactgcaaatagctgctaaacttggcaccatgcctggaatgggataggtgcttagtaaaggtttactgactgaacaagtgaacaaacgaatgaatgaatggatcagtgcataccatcctaaaccactgtagcacgtcccactctgccttctctgaatccctaaaatgctgcttcccagtggctacacagccccatctaggaggatctctcttttttgttttttttgttgttatttttttattttttatttttgagacggagttttgctcttgttgcccatgctggagtgcagtggtgcgatcttggctcaccacaacctccgcttcctaggttcagatgattctcctgcctcagcctcctgagtagctgggattacaggcatgcgccaccacccccggctaattttgtatttttagtagagatggggtttctccttgttggtcaggctggtcttgaactcccgacctcaggtaatccacctgcctcggcctcccaaagtgctggaattacaggcgtaagccactgcgcccggccctgttgtcattattttttacttgtcttacctccccgattagacaatgagtttctggaagaataggacattgtcgataatagtaacagcaatagcagctaccatttattgagcacttactgtgctcctggcactatctatgcctttatgtgtattaacccacttgtgattttaattcttgcaggaaccctatgatttatcactgtcccaagttcatagaacagtgtttttcaaacttgagtgtgctacagaatccccaaaggacttgttaaaacacagattactgggccccacccccaaagtccctgattgagaatctctatttccacaagttctcaggtggtgctgatgctgttgttccccagccacactttgggaacccctgttctagaaggttcttattccctatcctatggttgaggaaattgaggctcagagaagtcgtgacattcccgaggtcctgcggctaggaagcaccggaatgatgacttcagcctcgacatctcttgtactaaagctagtgccttcatcactgttcccatgcttcttgctgtctatttcttcttccccagagaaaccaaccgttttctgcctgttttttatttttccagcgtgagcctaccaagggagccatgagatcacttgctccctttcatctctctaaaccaaagcaatagctagtgagtgctaatggtggtttcccatgtagcagccagcttcggctttggcttgctgggatcagacattttccagaggacgttggtgtgagtaacagctgagcacctcagggaggctgcaagcggggaggctgccactttgagctcaaggggttcttcaggttgcagggctggtggagggattggctctctctaactccctgggttaggaatgtacagacagaatattgtctgtaatcttccccagctcagatgagagaaaaatgtgtctctgctcccttaatggggcactgatcattcgatcagccatttattcacttgtcagacattcactgcatttattcttggaatatttagggcttccctgagtctttcatttattcgtcgggactgagcctaactcagtgccaagccttgagcagagggttgcaaaggggagcagaaaaggcccacccctggtctcatggcacttaagagccagtgagaaagattcattcattcattcattcattcattcattcagcaaatacatatggactgctgacgatgtgccagcccagttcttggtgctggggcttcagcagtgaatgagactggcccagttcctccctgtgtgaagctcagtgtccgctgaggagacaggttaccagacaagctggaaagttaataagggatgtggtgcagctgctgactagataaaatgaagccaggtatgggatagagcagatcaaggaggtggggtctggggcgagcagggagggcttgtctgcaaggtgacatttagaagatcactgaaggatgaggaggttccagccaagggaatatctgggacaagactgcaccaatcaaagggaacagccagtgccaagaccctgagacgggagcagtcagatgcatgcacagaacgcagaggaggccagaggagctggagcagagcagaggcaggagagggatggagcctagagcagttggccgagctgagccttggagctggtgtcacttgaccaccttggagtggttatagaggggttgagcattctgagcagaaaagtaacatgacatcacttatgcatttcagatagggagaatggagggcagggaagcaggaatagaggtggggagatcaaggaggaggttcttcaggaatcaggggagttcggatggtggagaggatggggtggctggctttgatggatattttggaggtggagccgacgagccctaggttggattagatgagagctgtaaaggaagagagagaagaatcaggactgactcccacttctccagcctgagcacaggatgaccgatggtagagctattcactgaaataggaaaatccaggggagacacagatatggggaaaatgataattggttattgtctgaaattgctttgaaagagaagaacccaatgttttgagaatggagtttgggggttcagtgaatatttccccaagaaaaggctgtttaaaaatagcatctgaaggaagaaaaggattaaagcagattaagaggcagcagcatggagcatgcaaaggccctggggcagcctgactggcattcattccaagtcactgtttttgagcacatgtggtgaggaagcatggcaggcaggcaggcagacagcaatagaaaccagatatgcagatagacaggagatctgagattgtcatggaggggcagcccagccagcgcagcactgtcagcagagccatcacaaggtgacaccatagttgagtcttgaaggaaacaggaaagttagccaagaggaaaaatgatcaaaggggtccttcgaggctgctattgaagcatgaagtacataacatcaaatgccaccccccccccgaaatatctggtgggcagatgagtgggtacatgagggcagggcagtgaattagcctggaggcagcacgtcagaccacgtgggactctgagcagggcgatgagttggacttgaaccagccagccagtgggaagctccaggagggctggaggccagtagtgtggggacagatctgcgtgatcttccccagcagacgtgcccctgctcctggagggttctttctgtggccacgtggggcttgtcatgtctcagaactgctttcagagccaagcactcatgccaaatccattaataaccctgctgccaagccccactgctcatttctgacattatccatgctaacatccccggggttgccggcttgagaatttacacaacttctgccaagccagtggctctggtttgctcatcaccttgaccgtgaccctccagtgagtcaagtcatgacctccaattacagaagcaagtgcacgaacaacttctttgattaacttggacatcttggtctttttcttttctttctttaatgatgatacatagatgtttataatacagaacatttggagaatatgggaaactaaaaaggagaaaaaaaataccatgcaaagaccactgcagtttgcattttgctatgtttccttccagtgttatccacacatttttcataattgagataatcctacagagaattttcctttttcacttatcattttaatgtaagcaattttaacttaaaaaaaaaacctcctcataaaccttttaaatctttatctgtggatttatcctaatttccctaaccagtcccaattggcagagccctaagacataaacctcctcccccatccagcccttgacaaatgcctttgtgttgaaagctttttctatattttgaattcccccaaaaaaaagtgcaattatgagtcaaaggatgaggacatcttccaagctcttgattttgccagctgcttcccaaaaggattgtactggtttgcctctcccaccagtgacgtatgaaagctccagttcatttcaccatagcttccccagcaccaagtattataatttttaaagatccttgccaatagagtaggttaaaaaaatgatagtgcattgcttagaattcctttttagtgagattgacccctttgtccaaacatttgatatgcagttgtatttctgttatgagtccttcgttcatgtcctcaacccatatagaaaatggagcctaaatgttattcttatcagtttgcatgagcacttgagatagtgagggtatttttatctgtgtgtctctttcctttttaggttgcatgagcccgagaagaatgccagagaaataacacaggtacagtccttggtgagatgcccttcctgggaaactccgtggcgtggttgcttcacatcaaccggaattgcagatctggttctaaattaagactccttgtggggtggagggtggaggatcttacactcctagctttccccatgtcctgtgcatattccttctctctactgcagccaagagtggctgttgcagcctcatgactcagtgcgacccattgcacaactccccaggggcaccattcacaatccgtcctatgaaaatggtgccctggagtcaggctgcagctcccttagtgtggatcgtgccttcccatctctctacatttgcccaggcccatccctctaccaggagcgccactcccagctcactgcccgctcctcacagccaggcttttctatgctggaactgcaaagcccagcctgccagggcctctcccacctttgctgatggaaagaccccatgtcattaattacctcacacaagggcacactcactcaagctggaggtttctggtcagcattgctgagatgattttgcagcaacacggtttctgagaaacctagccctgcttatcaccggctgatgctgtcagaccttgaaggcagagggctgctcagcatcttgtaacaagacaggccctgctctgaacccggaacgagagcgcgccagctgtccttgacatttccaaggcagttgtcatctttttagatgtaatctgttgaaggagtcgggctggtgaaaggcgcagcatttgtagaccaaaatgccttggccctgcccttgtgacccatggggtccccccgcagccccggacatgagctcgagttgtaattaagaaaaaacaatttccagtcatgagcgagggagatcttctcccccatcattttacttctggacttcctcctggaatcttctgggggaaaaaaatgatggtgagaagaatgggtcatggaaacctctacgaaattcacagcagagacttactgggcacccactgtgtgccacgcactggacagtgagccagacagtcacagcccagctggcagagtgcctgcgattccagtgccaggtgccagccctggccagggagggagttgcacgctgtcaacacggatttcccagacagaagcaaatgagagcacgcagggctcaggacagaggagctgtgtgctaagagcacagtcgtagagtccaacacactttggttctttgccagccggacaactttgtccactttattgaacctcccttggtctcagtgtcttcagccgtaaagtggaatagataatccttcccaagcagggttgtggtaagagtggatggggtgatctatgtgattgtgtgctgcttgtaagccctgagaactgaaatcagccattaccgtgcaccaactaggaggtgtgccggttggtggtagctttattctgttctatcacgcaggggccagtcacagagggagcaaagtttatcattcatgatgggcgcttttgaggcggcagtggcaggttgataggattagcacatgggaggtatccaagtttgctaagtggttaatgattgcgaacatttattgaagacagatgctcaataggtaccaggctctgttctaaacgctttacctggataatctcattccatcctcacagcaaccctggcagtagacactattatcatcccctctttacagatggagaaactgaggcccagagaggttaagtgaattgctcaaaatccctgagctagaaccaggattcaaacccaggctttctgactccagaacgtttcccgcttcactaactggcgatctcgttcttatactgcccctgttctctgtctccctgtccccagctttgccctgagtgaaggtgaaattattgccatccactcatatattcattcaatatggatcagacttcttatgtgccagccttggtttctgaatcataacaaatgcccagtgaatatttgtggaataaacgcatacattaatgaatgtccccacacgtaccaccatcagcagcacctcctcaggcccccaaacagacatggtcctgggtagcgggccctgtgatggaaaacaaacatgggctgaggaagcacaaagaaggaacatggaccctgccaggagaggggagagccagggagggtcttagtatgagccatgcttcatctgaaatttacatggtggattgggatttgttacaaggagaagcaggacagacaccctcgagggatgaacatgagaaatgggtgaagactgcaggtggttcaggctaggaggaggcaggaacgggaggaggtgacactgaggcggggctgtgaggagactgcactgtgcgggtcagaaagacccttcaggcagggtgaggaggagggcagatgggaaggggcaaggctggaggcaagtaacgttggcaagagatgaggggaacatgacttatggctgagccagtgtgggccgagaggacacagaagcatccagacttggtattcagtttgagtgagtgggccaggggctatagaatgaccttctcatgactttctctttgggtatcttaaatccaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatga

SEQ ID NO: 191 - DNA, 38089 bp, Homo sapiens
agcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcaggtgaggggacccgctaccaacttccagcccccgcgaaactgacccgggctggtctggggggcgcagggacggcgaatgaggggcaggcagggctggagcgggctgaggagggagaccctgacccggagggtgggactacggggcccgatttctgcagaggtcttcggaccaccggagacagggaattcggtttctcttattgttcaaggtcagtgtctccaagtggacacgactccttacagaacacctggtccctctgagagtctgatgacattcgcggatcgtgtccccaaacgttcgctcaaacttaatcacacagctttagtggtccctgctttaaggacaccggagtcgcgcactttgcccatgtgggggcgcgggcgggtgggctgagccccttcaccgcggggtggcccggctcccagcgcccaagcgctgtggacgcgacaggtgacgggatccgacgaaggtcccgcctggagcgcttccaggccctgcccaggcacgggcaaccacgaagtggccgggaggatgagtaaccaggaagggacggccagatggtccctggggcagccgcttactgggcggacttgcgagcggtggaggcttggggctgcagaggtgcaaaggagggaagggggcaggggatgaatcccacaagagctctgcttctgggaggacagggctcttgcacctgtttcctcggtggccctctcggtcggtctgctttgtatagagtgcactccgtttccaggggtgcctgtcagctgcgaaaagcctgcctggccccggtgagcctctggattcgaggcctcacctgagctctgtggtctggcgggaaacctgaggtccgctgcgctccctgctcagcttggctaacgatgccagcgccggctagtacgcaaggtagcctggaatttctcagcccctgacctcgacagttgactttcagagactctcagcatttagcccggtgagcgggggcgatgaaagtgattccagaatggactggtgcagccagagtcacccttgggagccttttcctgccacctttggttaaaaccatgggcccctgcacccttaaattgacttcaatggagaattctgtttctgggccaggttcccgcttactgagatttaccagtcgttgcttggatgaagcattggcaataaattttgagaaaactatcaagaaaatgtggttattttggcaacttgaactcccgtgcctcccatttgtttgtgatttgtaatgcatcaaattcccattgtctcacaatgtaaagaaagacattatttaattctgggggtctgtccggagagacttgagcgtattaaccaccagcatataaccatttacgttggagttacttggaggctgtcccaggggagtttagggaccaccataaggaaatcttatttacgtaaaatcaagtaatttatttacgggaaagtaagaccaactgctattgacagactatgtcttttatcgactggagttaccaattatgcctaaattattctccctcaacaaaatgggaaccttccttccttcctccttgttcctaaggacaatgatctaatatgttggtactttatttctgtatacaagttcaggttctttctagaaaagtgccgaaagggtctgaagagtcatgttagagctgctcacccaaatataattgcaggatgctcctcagtggagaacagatgattgagttcagcagaagatttaaaatgtagggtcgtattaatacttaccctactcgggaggctgaggtgggaggatggcttgtgctcagaagttcaaggctgcagcgagtcatgactgtgccactgcgctccagcctgggccacagagcgagaccctgtctctaaaaataaataaaaatttaaaatttgttttaaaataccctataccggcatcaggagagaaactggtgtcactctcctttagaaatagtggtatctctgtcttcacagtatggaagacctgaagatggtcttaacttaccacaaaagtttagactgggctggaatcaggtggtttcctgcacagcccccctcccgtgtcctgttcatgagcctctttttcttcccatttcacacctgagctggagctgtcacatccatcatcattaccgcaaatagtcattgatatactgaccacctgtggtcctttgagtcagcgtttaggaatcatttggtagcctcctagcaaagcagctggctgtttgtttgcagggtatttttttttccagcaactgtaaacaatcccttccctgcttagcatgagaagcctgcaacttcttaaaagcagttggccttctgtggtctgggtttgtcatctcaaatatcctcactgtttttggtcttggtgatgtttccccgtgatgtcaggtttggactgcgtgcctgcctgcacaggtgaagctgaatgcctctcctgttatgagaaaacaaaaggcaggcccttaagcggggagggaccgtgaaacagagaactacagagacatggtagactgacttctctaattccacagaccattctgcaaacggcccaaacaagagcccgggatgaaggatgcatttggtggttttcagcctggggttattgtttcgtgttgaccaagtcttgtccacacagcacacctattctggactcagctggccatcttctctgtggtctaggactccaaccttctccagtgtagaatgttacaaatccagtcccagccatgtgtccaggagtgagatcatgggaggatttaagataagcttaaagcaggaccccttctcaaaaatgttgaaattatataaaatagaaggggaatggcaagtgttaaatatgctggggcagatttaaaatgcaaggaaagagcttggcgtgaattgggatgatccaagaatgcttcaaggaagtggtggttcaggcacccgcacagccttcctcagcaaccaccccctcaccgcccacccccaggatgagtaacctaagctgtctgagcctctgccactcttttctaagcctacacttctgtcattgaagactgactcaaatgttactttactgtatggctgaggctggacccggaagcaggaagtttaccttggtgactggataaaaataatagttaagattttatgagtgcttactgtgtgcaaggcactgttctatgagcgttatacactaggctgtttgtttcaccagagcattccgggtgctagccttgtgagtgtggcgatctagaaatgcgtcagtaaattggtgtagaaatctctactggctttaatcaggctatataactacaattaaacctctgggggcacgtcacagctttcttaaatggtttttattgcaaatgaaatgagaaatagggctttattttttttttcattcccttctttatctgctgccaaaacagacttatttatggtctgattttgaattttttctacatttttaaaaagttgccttaaagtatcttggtatgtggtaatgtggggctgtgcagtggatctttttcttattctaggcctgtgcctataaaaatcaagattagtaaatagtgactacaaaatagcgacttgctggctattattgaatttagtgaagaaagcagcctcgttgagatggttttgcttattaaaaaaaaaaaaatcctgtgctccaattcctaaatggtggtggtttttcttgttaaaaatttcagttgtaattttccattggctttgcattttcttgaaaaggacacgattgaactctcaaaatagcctctaactgaatatattattgcttaaaagaaaacttataagtaggcaacacaaataaaccccatagcccttctttccaggcccttcctccggaatctaaaacctaataccaagtgaaaatatagggtttctctttggttaaaacttttctacattctacggtgagagaacatcatcaattatgtaaaattctttctaaactagcttttgaaatgagtcactcaggcttaaagcaggttattgtagcttctgaggaaagtgagtgctccaattcctttaaagaacgttttcaattggaaaagagtaagatgaaatctaaatatttgaacttgctaagtaatgatcacaatctatggcccaggctcagaaaatctgctactgaaccttaaatgttgagaataagacaacctcattttatgattctctacatgtggaatttatactgtaggtttttgttgtttgtgggggttgtgtgtgttctttctaagtaagccttcatgtggtatttttgcacacaaaatgttctagctttgctttctaaagctgttctcagctgtggtacatcatggaccactcaaatgaccttccatcgtttgctgtttttctcaacgttgattgaaatgtcttaagttagcctcaggaattcagttctgttctttgttctgtccctcttttccttctgaccttggagcagataatcagctggtcagtgattctgtacccctatagtcatgcaaatagacagaaacacactcatgtgttgtacaaagcctggcccaaaatactcatccttggcttgcttttgaaggtgcctctgagaggacatttctgcaggactctatctgaaacctaaaaatatcctgtttccctgaatgaaaaggagaaagctattgagtttagtaggaaactcaataaatggtattaagcacggccttatgaaggaagattaacaaatgattatttatcatgtttgtccttaagggtccagaaaagcaacactgagtatattgttggagatgtcacatgtaagcatattagcaagatacttatactaaccgaagtgctacttgagagactattgtattaataacaaaaagatactagaagttgcttcaaatcttttctcttctaccatttacacaatgccaaggaaatagagaagtgcagatgtacataattgtacccaacagatgtatatctgaaaaagatgtaaatcaagttacattttaaattcagcagagaaactcagaacattaaaggagtataaaatatcggtggtatagcaaaaaaaaaaaaacccctaatttatgttttaccagttggcattataaatcctgttttacatactttgtgggggttgagggagttagggaacctatcttatcatacctcagtatttctcctgcattccttctgtggaaattattcagagatttactttgaagttacattgtatagtagaatagttcattacccctcaaatgattgctcagcccactgaggcaaataagcgtctggcccgagatgagcctgcccatccttcagtgacctgtgaattaggcaggtacatccaatgtctgttcagcccttataaatttatcaattataagtttaccttgtatagtcaagacccaaggtcttcacctcacagcatgatgcctagtgtgttttagtcaaggcactacataaaacctaagcaactggcactacacccaaagcatctcctagaaatggagtttataagtcagatttttgtaaacgtgattgtgttttaaagacatgttagaaggatgctacttaaaagcagcttaagtatactttaaatggatgaattgtatggtatgtgaagtttatctcaatgaaactttttttttttctaaagaagcagcagcagcttggggtagatacttttgcaaaatgaaggcattgtgtagtacagcgataccagtaatcacccctccccccattcgtcatttttgtttaaagtaatatggtaatactctgcattgctcttagttgaagagtacagtgctgtgtgtcaaattacaatgcaaggcactgttagggaattcaaaagaagtagaagctcccatccctgccttccccacagatgtgaacatgtttcatcctaaaggagaagcctgtgactgtatagactcttttttctttgagtgatcattttattgttttattttgtttgagaagcctgtatgtttgtttgtcttataactcagtgagttatttatagaaacagctcaggttcatgtatagctgttacagctcatcctctttgtcttctgttattcatagttactgcaacaaggaggtatacaataaggagaatcttttcaacagcctgaactatgatgttgcagccaagaagagaaagaaggacatgctgaatagcaaaaccaaaactcagtgtaagccatttgttttgaacttcagaaaaaagctgtttgaagatagttatgattggttcttggatgaaaaaaaataacacctcccatgtcacacatctgcctcagtgttttactgtgtgtcactgacagaggttactgagatctcagcactcagaaacctggctgtgcattttacaagcaagattaacatgttctttatagtcttgtttgtaagtcagttgctagttgagggcctttttttcctgctagtcattcgtatttgacataggttattttacagtgatgtggtcagctgaatcagttccagtatgtacttttattttgaactgttttgaggctttgaaaacagatttttctccctctttccttgtataaatcttattaacatttctagatactatatataagtatcagcagagaatataaagtggtattaatagcaggaattacaggttattttatctgtaatgcatgttttcctcatgttatctgtttgattttcatggacttatgtaagtttcaggtttggcatttaaaataaacttgtacttgagtattaggggtgttttttttttttttggtgttttttgtttgtttgtttttgttttttgagacagagtcttgctctctcacccaggctggagtcagtggcatgatcttagctcactgcaacctccgcctcttgggtttaagtgattctcgtgcctcagcctcctgagtagctgggattacaagcacctgccaccatacccggctaatttttgtgtttttagtagagacagggtttcgccatgttgcccaggctggtctcaaactccagggctcaagcgatctaccccgctctgttcacagcatgtaactcagtctgtcaaagcctaatttcatttttgcggggggacggagtctcgctctgtcgcccaggctggagtgcagtggcacaatcttggctcactgcaacctctgcctcccgggttcaagtgattctcctacctcagcctcccaagtagctgggattacaggtgcctgccaccacgcctggctaatttttgaatttttagaagagacggggtttcaccatgttggccaggctggtctcgaactcctgacctctagtgatccgcctgcctcaacctcccacagtgctgggatttcaggcatgagccactgcatctggcctgtaatttcttatggcataatgctttagaaaaaaaaatatagtagtttggagctttggtatatgaaatctggctctcaaagatttagagtgcttcagacaaagcaacttatagccccagtatttctacactgcagaaattaagcacttgaaacttcttcagttgtcagtagactccttatcttttttgtcaaaacttttaaaactttggaataaatgaaatgaaatgtcttaaatcttgagcatgttgcagatgttaaagctgtgtattctttttgtctctgtagatttccaccaagaaaaatggatctatgttcacaaaggaagtactaaagaggtgagcatcccattcatttactaagttatactgaaccttatcccttcctgatagcgcagggagggatatggtagggagggaaattacttcggatcatgagagtcttcttggatgtgggagatggcagctattagtctattatttagccaaccatcagagtttagaacagagagagaaagaagcaaaagtcactaggtggaccctctagtcgttcaatgagattatgtatgtaaaagtgctttataaagattgacatgcccatctcaaccatattattatattgccctgggttttgcctcagggcaaggtctcccttttgttctaagatctctttggacttcaactcagttaaatttcagtcctggaagcgctaatcactaaatatagtagaagttttcagtgcctgctcagtgtgatgtgggaggggacaagacattgtaataactacatttgtatggtactttataaagcccttttatgtatattttctctctgcacaggcatttgctaaaataactaggatacaggcaatatgaaagaatttctatgaccgtcagggacctcagtgaacatctagtcccctctgtgatttgaggtccagaggggggtcactgatattcccaagaccacccagatactcagagcagagctgggactttatactcccaattccctctgtgttcataggttaaaagatcaaaacttttgcttcctcccaaaaccttataaacacttctgatgatcacagtgagaaaagcactattggtataaggcaaggtggtgacacagttggtgcaggtaggtctaattctcctcccaggagtacgttacagtcaccaaccatcatggcctcccatgtcccgtaccctgctcccagtctttccttaataagcaattacttatgatttttccagactaatatgtggaaaaattataagcaaggtcccaaatggtacaagtcacgaaaagggggtgtttgacatgtgaggggctgactgaggcagctgctggctgtgttacccatcttggtggctctcaagggcttgtgggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccgggtaagtctcaagtgcctaaaggctcatccaggctctttcccaagttgaatcatctctttgggttgtcttgaagtagtttccccaaaaaattactttttaggaccctaagaattttgaggcaagcagaaaacagacccctcaatctccttcttccccaacgtacttcaagttcttaagtgagtcctactaggatgtccctgagattggccaggatgggcaggggccgccataataccccagtgagtcggttaaagagccattctcttcaagtgaaatttcacaccaggccccttccgagcccaccctgtggatacgtgggaacatgtcacaggcaacgctggccctggcaacagccttagcaagagagaattcagcaggaagcaagccctaaagcactttggactgtttcaaaaccctgtatctctgactgttctcactgtctccctcttgtcctacttcagctgactctgggggacccccaaggcattctcagatgaggccacaaaactggatgaattaaagcacctccgtgttttgtgcctgtggttcccttccacccccatgtgataacagtattcagtcccatgtccacctaaagcttaaaactgcctgttttggccgggtgcggtggctcacacctgtaatcccagcactttgggaggccaaagcgggcggatcacctgaggtcaggagtttgagaccagcctggacaacatgatgaaatcctgtctctactaaaaatacaagaaaattagccaggcgtggtggcgggtgcctgtaatcccagctacttgggaggctgaggcaggagaatcgcttgaacccgggaggcagacattgcagtgagctgagattgcgccattgcactccagcctgggcaacaggagtgagactccatgtaaaaaaaaaaaaaaaaaaaaaaaaatctgactggatctgttgctttccattttaaaccgtattttgagaaaaaaaaaaaaaggctgggtgcattggctcacgcctgtaatcccagcactttgggaggctaagacaagcagatcatgaggtcaggagttcgagcccagcctggccaacatagtgaaaccccgtctctactaaaaatacaaaaaaaaattatccaggtgtggtggtgggcgcctgtaatcccagctactcgggaggctgaggcaggagaatcgcttgaatccaggaggcggaggttgcagtgagcgagatggcgccattgcactccagcctgggcgacagtgcgagactctgtctcaaaaaagaaaaagttaatgagcaaaatattaatgatgaaggtagtaaagcaaatcagcttaaccatgactgtcacattattatttctaattggtttattattttgttctccctgcctgccctccaaagctcccttgtgtatttttgtcagcagtcaacctgggaggtagcagctgtttgggttttaggcttagaagtaggagggaattttccccctgtgggtgtggttggtttggtttttattttctttttcctgggttgttgtgcttctcggtgccatgtcactgagtcagatgattgcagaggctcagccagggtgatgacattcaaggccccttgaggcctggatccttcacctgtcatctgggcagatgcaggcttggctgtccaaagtgacctgataaaaacgcaggcctgcaagaagcaggttaggagctgtgagctgagcctgtgaccacatgagcagatctattcactcttcggctaagctcttcttccaatccaaaagggataaaaataagagaccttcttgggtgaaatgttcatgccattcagtgtgactctgcaagttcacggaggtcacctagtcctcctagggcccacagactagtctaggctggttggaaatgggcccaggatgatctggaaacttccattgctaagaatccaaatagtttccatcttctaggtattagaggaagacacttagatctgatgtcttattacaaactgatcttcaaaatggtcagtttttagatggtcttcctttctacctgcttttccttttacaagaaataaagcaaggaacaagcatcatgatagtgaaaatctatttcatcaatatgttcattttcaccttttatcttttcaataaccctttaaaatatgggtgcttttattatctctctttaaacaaatggcagtacagtaagataaaatgacttgtccatgatcacagagggatgaaatcaagacttgaaatctgggcagtcagagtctacacttttaactgctaccatgagttatctgtgagcagaggagctgaagtaaaatagcctgagggcaggtcctagctccactgatttcaaactgtctcaacctccctaagacatggtttcctcctctgtaagaatgacttacctcaacttcccggggtagctggggaaactcagtgatataaacagaagtactttggacactagaatctatctgctgtgcaaagtcagccgctaatgtttactgttacccacttaccaaaattattgatttccccctaaaacgcttttcagttgagttgattaaaatgttttctacttttaaaaaactaattggtgaatctggcaattgcttaagactcagcacagagaacacgtatctaagagtatctaattgtaaaatacatcatgagcgctttgctttaaataatcttagagaaactgctgaatgctttcaaagttgttaggttcagaaatagtggaaaaatatttctattttgcaaagaacaatttttccccatcactattagagacctctgtaatttgaggaataatatgttatttttatgaagaacttaaaacattttaatgatagccactgtgttttgaggttttccttcttaggaactcagtatacttctcatacattcttatccttaaaccaactctgcaaagtagcttgccagtatattatccccatcgtactactttgacctaatgttgtttaaatgctacaatgattactggttttgctaaggagctaaactgattttaagggccatttgggaaaaaaacaaaaacaaaaaaaacattcaaagccttgagagccaaatacattttctgaaaatctgttatgttcatgctggttgtcatcttccaaaaaagagacatgcagaggtaataaaagagatggctaacactgctatctcaaaatattatcatttttatcactcagcatgaaaatttcacgaatgtttagagtcagaaaattttttactataacttagaaagatgtttatataacatttctacatcattttcactggctacaagctacatgcattggccctgctccctcccctacacagccccaatgacataaagacagttctagctatgtgtttgaaagatttcacatctctagaaacagcaacttacctacttgtggaaggacatttaaaacatagtttaccctatacctcaagaccaacacattttggaaattcccttgaggaactggaaggattccagaggccaagccagtcagactggaagtttgtaaccatgagtaggtgagtgctgactaaccaggccacagagaggtcagaggatcgagtgagtcttgggcatcaagtcaaccaggagaaggtttcggagaccatcacccatgtaatggctctgcagtgagcctgctgtgaccccagtggttctcagtcctggctgcacattcaaatcaccttcgaagcttgttagactacagaagcccacctctggagcttccgatttaattagttgaaggtggtacccaggcattgctacttttaaaatatctgcctggtgatcccaatcagttttcaagtttacagaccagctcagaaactgctttggagcccagatattatgttttgcatattaatgagaatttttaaacaaagtgcactgagacattaaactctagatacgacttctggggcgtgtactgtggtccatcaggaatttagtgatggaaagaggacagcccctcctatattccagctcaaagttcgaagcttctttttttgtagtactttctgcaaatcaatcattttacttctctaaactgtaaatctaggataaccatacctgtattgaagcatttttatgagaatgaaaaaataaaatgtaaaaataaaggcagtgggtgtgaaagtgttatataaatttcaaaatgcaatgtaacttacttttcagaaagttaagtaggattttagcatatccaaccatctttccagggtgattaaaacttgaagactgaattcatgggccagatacagttggggacagagattagcctatttgcaatggaacttttgaggtccttagaatggtcgtacatttttaaaatctttatattctccccagtgaggctcagtgacagaaaacaccaacatttacccaaacaactgccccgttcccctggtccttagtgagtcccttgagaaactgcattattgggataagatggaattaagataaaaactgagcagtaccaataaaaaatatgactttaaaagggcatgaaagcaaccgttatttagtatctgttattgctgagtacaatgtaatatagaacttgaacttgaattcaaacttacactcctccaaaacctgtattattttctccaggccctgccactagccagtgagggaaatagatgaaatagatctgactctaccttgaaggtctgcagcaggggtcagcaaacttctagccctcaggtcaatagcctgccgcctgtttttgtatggcccatgagctaagaatgatttgtacgtttttcaatgttttaaaaaattgaaaggagtataatgtttcataacacatggaaattatgtgcagctcaaatttcagtatccataaataaagttttattggaacacagctacgctcactcattagatattgtctatggctgtttttgtgcaaaatggcagagttgggttcagagttagcaacagagagcttgtagcctgcaagcctagagtatttactatctggatttctacagaaaaaaaaaaattattgccccctgccatacagtctgactgatagcctgagaagtatgcattaaaagaagttacctaccctgacaccatgagaatgaatttgaaaagaaccaagatgtggtagaggcagataggctatgaagtttcagaagggtagcatcactgtgggcaggatattcaagaaagacttcaaggaaaatgtggggtttgaactggtcttgagtaggagtagaacttaggggaactggtttgaggtaggcagctgtaaggtctgttcagagatcagtgagcagaacattcaagtatggacagaagtagcacagtgtgctttagaatataggatcatgggctgggtgtggtggctcacgtctgtaatcccagcactttgggaggctgaggcaggcagctcacttgaggtcaggagctcaagaccagcctgtccaacatggtaaaaccccatctctacttaaaatacaaaaattagccaggtgtggtggcacacacctgttaatcccagctactcgggacgctgaggcaggagaatcacttgaacccgggaggcaaaggttgcagtgagccaagatcgcgccactgcactccagcctgggtgacagaggctgttgttttagaaactctgtctcaaaaaaaaaaaaagatcatcgaagggtgttgccacaagctggttattatgatcttggtcaggcctcactcgcccatctgtaaaatggaaatgatgacaatagcaccctgctcctaggtaagatgaggactaaatgagataagcagtttatgagtgttagtcatgtgtagtaagaagtttataaacactagggatgattgttcatttaaatatggctagaaaaggacattggacagacttgagaagaggctttgagtgtgaggctatattatctagtacgcaggaggaagccactggaaaaaaaacaagaaacagcaccttggccaagcagtgtttcagaaagtcatgacttctaacaggctctggcatccccagatgccatcaaccagcaaattataaatctgttactttgtggtttacgaattccatctttgtatatctacgtctttgataagcacagtcaagctgtacagtaggcagatgttgttaacccattttagaggtgaggaagcagaggccagggaactgggtgatttgcacaaagttgcctgcccaggaagggacgtggaataaaggcaggacctaagcctggttctccgactcctgctccagtgttctctcctttcgactgcattgcttagagggcaaaatgcaaaatggagcctgccttttatcaccactaaaatatttgcacacatgcacacaggctatatcgcaggagaggttcttaatgccagaatgacctttgatctgattactcctagctctctctgtagaatgagaataagcccaagtctacagtaactgtagctaccattaacagcccagaaaggtcacggagaacttgagtaccaattttctcactggagtaaactgacccgtatgtgctagtggatcaagaagaacaaataaaagcttgcaaccccagtttctttgtccctctgcagcagagcatcacaacctaaactgatgcacattcttatttttttctgcgttaccaccctaagtgcatttgaatgtttccagcaagttactgcattcctaccacccctgaaagcattttccaaaaacatgttttagtttaagttgactggtggtttggcaaacaaaaggctggaatatggcacgatgactcaaatttaaattcaatgccttaaattaagggcatgctgttgccaagcccctgctgggccttgatgtgcatcagcatcctggccccttcacacaggttcctctgccacagtgaccttggattcacttaaggctgtacatgcagtggccttcctctgatggagggtggcctcggccacctgggctttaaactggtgctatctgggatggagaaaaggccaaccactgcagcagcaataaagccaaaagagcagagccacgggcccatttgaaaatgatgcacagagccgggcgtggtggctcacacctgtaatccgagcactctgggaggccacggcaggcggatcgcctgaggtcaggagttcgagaacagcctggtcaagatggtgaaaccccgtctctactaaaaatacaaaaattagctgggttgatggcacactgctatagtcccagctactctggaggctgaggcatgagaatcacttgaacccgggagccaagatcgtgccaccatcctgcaacctgggtaacagagggagactctgtctcaaaaaaagataaaaagaaaaaggaaaagaaatgatgcacagaagtgattgtgaccccacccttctgaaacttcatagccaactgcctctaccacatcttggtactggggtcattaactttgagggtacagggtgggcccttcaatggctggttaaactgttagtgatttcacaggaggaaatctgtatctcttggaatttctggccttgttagtcattattattagcattcagacaggcagatcctgcggtgtctaggtgcccacggaagtgggggacactcacagacggggggacatggccacagaattggagggggctgtgcagaaaaaggaggccacctgaaaaagtgggagatgcccacaccaccctagatgtagtagggtatttgaagaagtaggagggtacccacagaaattagggttcccatggaaatgggggaagactaagactagagcatagactcctaatagtataaaataacttaagcatgcactctcaatttatgcatattcataaattcacttataactcatatacctctaaaagatgccagtaatgatgtctaccctgcagtgttgctgtgagaatgaaattgaatttcaacctggtaaatgctgtagaaccgcgcctggtatgtggtaacattcaaggagtgtaatggttgttgctgttactgtcatcatcaactttagggaccttattgtggacattagaaaatacacaaaatcagagattaaagatgatataaaatactgagatttctgttttattatttttctacctgattttctttccagtaccacttcagagactgctggatcaaaagtgtgcccattttgtataatttttttttcttaatgactcaggatctaaacctataccaccagcatcccagcagtgttttctttcttttttttgtttgtttgttgttgttgttgttgttgttgttgtttgttttgttttgagacggagtctcaccctgtcaccaggctggagtgcagtgccgcgatcttggctcactgcaacctctgcctcctgggttcaagcgattctcctgcctcagcctcctgagtagctgggattacaggtgcccgccaccatgcccggctaatttatgtatttttagtagagacagggtttcaccatattggccaggatggtctctatctcttgaccttgtaatccacctgtcttggcctccgaaagtgctgagattacaggcatgagccaccgcacctggtcaatgttttctattaaaattctacctaagcatctaggctctgttgggggcttatcataacttaggatgtgccaaattgggcaggtgagctgggttttcagtgccagtcccacagaccttttctcatccaaggagggatgctcccaagagtatttatactgtgctctgagtatctgggacccagaatctgaaggcctcatgagtccactacaggaagaggtctctgatggcaaggagcggtaattgatggcatcctccttctaggtctccacatgcggcaaattgctttaaatgaatgcttttgagcccctgaacgggtatttctattttgggcccaagcacctagtgttgccatagccacttgagaatcgtgtcagacctagcccctgcttgtcaggtacttctgggctactctgggggacaaagtataactattcaaatggcaagttgaattagtacagtctaggagccttggagatggcttcttgaaagaggtagaacctgaaattctccttccttgagggacggccaggatttggccagatggaaaggcaagtggaaggctttgcagggacaagcaatgtaagcagaacctagaaatgggaaggaacaaaagtgaaggggaatgattgtgggtcaggggccaatggcgatgtgacattcagcctatagaaccatagggcagaggtgacagttgctggaatagatgggagctcagtttaaggaagatcgccaagccagacatcgctgttagatggatgtaatggggaataaactgccattgtcaactcaaaagtaaccagggccaggtgtgggggctcacacctgtaatcccaatactttgggaggccgaggcaggtggattacttgaggtgaggagtttgagaccagcctagccaacatggtgaaacaccgtctctcttaaaaatacaaaaatcagccggacatggtggcaggcacttgtagtcccagctactcagaaggctgaggcaggagaatcatttgaacccaaaaggcagaggttgcagtgagccagctcacactactgcactccagcctgggcagcagagtgagactccatctcaaaaaaaaaaaaaaaaaaaaaagtaaccaggatgggtaaaagatgaagaggcaagtctctctctgctgagaatacaattaatgcatgtaaacttggctctccttattattttaactccctctgttaaaagagagctgtttcacttgcaaataatatttatccaatcttgacatgcctgcagattattaatgtcgctgaaatttttttctctttcaacctgtcagtgttcaagctcaaagtcagaacaaaactttccaggttttttatctgtgttattcattgagtaaataagggtcttggaagtacccagcactcagagcagagagagacactgcctagtctaactaaaggtttattatagaagacgcaaccttcctatagatgggcacccaacttgggtattgagcatgtgaggcatggcaaggctgcttgaggctgggactcgtttctgcctttgataactctggcagattttccagtcagacacatacttcatactgtaacaccccactgttatacgagataaggaatttggggataaattgtgttctcattcttaacaattctgtatgagaatgatagagcatgcttaggcagcagccttgtggttttgtccttttaaactaacaggtagaggaagctgctatttttgttgatgcttctgaaagcccaagtgtttactgtccctccagatctcaggctgcttgcccttctggaaagtgtttgagatatgtttgcattataaataatttactcctaggcccatgccactcctggggcatcagtctggaactagtctccatatagatatcagcctgaccagccagatggtccaccattgaccttgatgtgtcatttggccatcatgagccacctcatctatagcaggaggaaattcgggtaaactgtttcctgagtcccttccagctacaacactctttgattcaaaaagacaaatgtatgttttaaaaaacactatttgttgagtgcttaccatgtgccaagctgggggtagagtgggaaacaggacaacacttgctgtcttgagggttccatcctaattagcctatcagcaagtaagtgaacaagaccaattcagatatgcataaatgcaacaatgaagaacaatgaaaccatagtaaggtgaagatggcaacagggaggtttttgcataagatggccagggaagggccctctgagcccggggcaggccacgtttgaactgagacctgagggatgggatggagccgagcatgtaaagatgtggcagaggcaaaggcccagaggtgagaataagcttggcctattcgagagacgaataacctgtgtagccggagcagagtgaatttgtgcaaaactaggctggaaaaggggtagaaaccagatcagggagaaccttgccagtcatggtaaggagcttgagttttttcctaagcgcaaggagaagccatttgaggattttaagcaaagaagtaacgtgaactgatggatttttaaaactatgaatgctatgctaaaataaactgtagggaagaagacgtaagaagcctgctcttgatacgagagcagtgagataagagggaaatctctcttctgcccattcgtcttgcacacaccacttcaaactttggttgatatccgctctgagatttgctatacgatattgcttgcaactagatttgtctcctattcgttgcctccagaactagcatgagccaaagctgaagggcaggatgtggtttcagcatgcggtgaccaccatccctccctccagtagctcagagccattcctggtactgcacggctcgtcactgcagatcatgccggatgcccagagtgcccacacgataatgacaccacggaattccagaggagccgagaagcctcctcctccttccccttccctccccctgcctctctttaaacatagccacaaattactagcacctgggctaaaatttgcccagtcaaaaacaagcagccacttccaaacaagacattttcctctgttctttttttctcttgtggctaggggcaaagaatccaattggctaagtcatcctggtacacagattgctagatacaaacctactttcctaggcacgcagctctcttaacacaaataaaatcgataaatttgggctgtgcgcgatggcttacgcctgtaatcccaacactttgggaggccaaagcaggcagatcacctgaggtcaggagctcaggaccaacctggccaacatggtgaaactcgatctctactaaaaatacaaaaattatccaggtgtggtggcgggtgcctgtaatcccagctactcagaaggctgaggcaggagaatcatttcaacctgggaggtggaggttgcaatgagccgaaatcacgccattacactccagcctgggcaacagagcaagactctgtctcaaaaattaaaaaatttaaaaatcggtaaattctgctctcttcactactagttccatacatcactacctagtagtagctctgggcctatagagtgatgctgatgtggaaagtagactctgtggtttacccaaagcagttgcctcatcctaaatgtgctggtagcactttctgagcattacagtgcccttaatattaaaagttgtttaccagtcacaacatattattatataaaatttcttttttttttttttttttgagatggagtcttgctctgtcgcccaggctggagtgcagtggtgtgatctcagctcactgcaagctctgcctcccgggttcacgccattctcctgcctcagcctcctgagtagctgggactacaggcacccgccaccgcatccggctaattttttgtatttttagtagagatggggtttcaccattagccaggatggtctcgatctcctcacctcgtgatccgcctgcctcagtctccccaagtgctgggattacaggcgtgagccgccacgcccagcccaatattatataaaattttctagactctgtttccccagaacataacaataaatggtattgctcccattttggagtaaaatttggccctccatgcaaattgattggccttgacaaactgaagtcctgaaactgtcagaatatatgttctgccaggcacagtggctcatgcctgtaatcccagcactttgcgaggctgaaacacgaggatcgcttgatcccacaagttcgaggccagcctgggtaactaggaagaccctgtctctacaaatagaaataaaaaaaattagccaggcatagtgctgtgcccctgtggtcccagctacttgggaggctgaggtgggaagatagcttgagcctcggaggtaaaggctacagtgagccatgactgtgccactgcactccagcctaggtgacagagtgagactttgtctcaacaaaaaaaaaagaaaatgtgttctctgttagacatatctgggctcaagtcctggctccagcatttgctactgctggtatggctttaggtgagtacttctctgagcctcaatatcctcaatggttaaatggagaagctatctcactgggttgctgtaaaagataaacaagattacaaatgtatagtgcttagctgcagttgctgacacatagtaagcaccccattgttattgttattgttagcaaaataagactccatggtagaaaaactatgcaagtcataaaatgtatcagcattaacttttatcaacagatagggtgctattaaatgtatcaccaacatagtaaaatgacagaaaggaatattacagtgtgaaagcatttatttatttgtttgacaacagctacaattgaaatacagcaattctgaaggtctttaaatgggttgcactttgccctgttaactcactatttcctgattggcaataattttacttggtaatgctctgtattatggtaaaagctaacaataataatttatcgagtatattctttgtagcaggcacagttatgagtgctatgtgaatacatttaatcttcacagcaactttgaagtaggtactattactgtgcatattttgaagatgggaaaactgaggcagacagtttgcctctggagccctcactcttaaactcttatgatatataccagaaactgtgacatagcccaggtgccaaatctggccctccacctgcttttgtaaataaagttttattggaatacacccatgcccactcatttacacattgtctatagccatttcggtgctatagcttcagggtggagtagttgctacagagaccacgtggcccacaaaccttaaaacacctactgtttggcactttgcagaaaaagtttgctaacccctgatgtcaactttaaacttcacaaaaagactggagtttaaagggaaagaaataatatcttataataaaaatgccttatgtttggtatttactgtggatttgtacatatttatcttacttaattctcatagcaatcctgtgaagtaagtagtctttttatttccattttagaaatgaagaatcaggagttcagagggattaaatgacttacactctaggctgaagagcaaactccatgagtgtagggatcatgtgtcttcatcatcatgtccctgtcacctaccacgatgctagcacagggtggacactcagaaaatacttgctaaatgaatgacagttacaaaggtcacccagctagagaatccaggtcttctcctcttccagggttctttctcctgactccacagctgtctgacagttaaaaaaaaaaaaaaaggtaggggggactttcccttgagataggatgaagcacagaatggttaacatgtcgttatgctgtcagttgacaaatttttgctgctatattcctccttctccttagagaagataatcagaccaaagacagttcgtttctcctccagtgcacagtcatagtgttgagagtttacttgtccttgtgattggtgcatattttgacaagattaaaactgacaccctcatgagatggtagtcacatggaatctgggttttggatggatttcaggcagagctctggctgccttcctcccaaccccttgccccacctcctacccagtgatgagtcacagtgcacagctgactgcccttcaaaagccgacccgaggcttttgttttctttcatctgcttcatgttggtcatgtgaggatcagggtattaatagaccatcatcttggccttccgaatcttgctgttggtcagggaggtaaatgaaaggtttggccagtccctttgtgccattttcactcctctcttgactgtcacgtgctggttggtggcaaagctaaaccacagcattcggtgtggtcaccgcccatggccatggtctctactggtgttttgatttcccgcctctttcagcagacactcggtgagctcctgacttccaactagatcaccagtactaattgcaacaaaccacctcctcctcccagtcagctagcctcatctctccctgcatgtggaaaagatacagaagccagggagaaaaaggagtttggtttgggggtggctttttttaatatgtaaagtaaaattacattcaggaaattaaaagtctgtgtgtggtttaacaggctcctaaagagctccacggggacaaacatgttatgcaaatgccatggaagcagaggtgctctgaattgcctaggccgttgatccaaaagtttccattctcctctgcaacccaatctttaaaatttcattttgcttcttccctcagccttgattccagcacccaccacagtgtcatgctcagtgtttattgatctgaaatgaagctgggctgaggcctggccaggagatgaaactctcttagaaagtttcctaggagcggagattctagcttcagtgtaaaggaggggtctcggttctctgtgtctagtctactgagtctcaggctagttattaccacaattacttttgcaccagcctaatagttttctctgggggcctggtgggttctcgtgaagttaattactttcactttatatcaacctcttttgtttgttaactctttgaaagcatgaagtgtgatattttcctgtgttgagaaggactctgctgagtcctcactagttgtggagtggctcataaggtgggtctcttgagcctcgctttgctcatctgttaagtggattaaactagatggtctcttaagattccttccagtctaaagtttcatttttcaacaataggatctttgttttttattttttattttttaagatggagtcttgctctgttgcccaggcgagagttcaatggcacgatctcggctcactgcaacctctgcctcctggcttcaagcaattctcctgcctcagcctcctgagtagctgggagcacaggcatgtgccaccatgcccggctaattttttgtacttttagtagagatggagtttcacatgttggccaggctggtcttgaactcttgacctcgtgatctacctgccttggcctcccaaagtgctgggattacacgcatgagccaccgcacctggcctttatttgttttttaatcttgccatgtcagtaaagaattttgctatagaaggtaaaaaagattggactaagtacgcactaacttcagttattatcttcatttatttttgtctggcaattatggggttggtaggaatgggacatactttttcaacaaacaaactggcggggcgcggtggctcatgcctgtaatcccagcattttgggaagccaaggcaggtggatcacctgaggtcaggagttcgagagcagcctggccaacgtggcaaaaccctgtctccaataaaaatacaaaaaaaaaaaaaaactgttagccaggcgtagtggcacatgcctgtaatcccagctactcaggaggctgaggcaggagaatcacttgaacctgggaggcggaggttgcagtaagctgagattgcaccattgcactccagcctgggcaacagagcaagatgccgtctcaaaaaacaaaacaaagaaaaccctttatttagcacctaattagtgccaggtacttgctgagggctttatgtgcattctcctattatcactcacaacaaccttgtattattgactctaccttgtattaaaggtattaaatactcaaccttgtattaaagactctaaatattattagtatagatgaacaaactgggtggggcaccaagaaatatagtaacttgcccatcatcacggagctaatacatgttcaaatcaagacctgaatctaaggccaagagctacaaggatccaagtttttagccacagtgacatcatataaaatacatccctgaatttctctctcttcctgtgattggcgtctttctacagaaatgtaagtgcagtgaaagagtctaattaatagacatgtttattgaacactgcagaagcaggaggtatcaggataagactctccacttccatggaaaaagtgcacatggctgctgaagatgggctttaggtgccttgagagcagtcagtgccaataaggaagaagttcaagcgggggcagaagaattcccccgggaggtgattctgcagaactcagccattcacaggtcatgggagattttgttcccttcagggtacgtcagcttcacttgctgaagtaggacaagtagattgaattagccctggctgaagccaaaattctttatatttaaaagaagaaaagcaattaaatattcaacccaatcctgggttttgaattaccccatttatctttcactctgagcatctgctttttattgcattgtggccctgcctgccatttatctctccccgtcagtctgtatccacgtgtcatgggactcaaaagtgaagattagaggagaaaaatatctctgtactctaagcctggcaacttctatttttatcctcagctgttggagctgatagcaaagtcacagctcacatccctgagtggcatcgcccaaaagaacttcatgaatattttggaaaaagtggtactgaaaggtgagccttctctcactctctcgcccctttttataggcatggaggtgggcagatggattttccaatgaagtggacgtgtcattagacttaaagacatgtgaatggatggaaatgaataactccagctacattttagagacactaaattccagttcggaaaggggtacaactcatcctcatggcaaagggtgagaccatcaccctcctgtcctttctttgggaccatccacttgccctactataagcctcgtaggcttctcagtgtagacacaggtcccaacactggctaccgagcctccgggtcccaaattcctagaaaatcgacatgtgtacaaagtcagaatagattcgtagactattcgagctagaaggaaccttaggtctctggttcaactgactcattgtacacatggtgaaactgaggcccatgaggagaagtgatttgtccataatcacacagagagtcagccagacaggattagaacccaggctccaaacccctgaaaccatgctccttccactgactgtcctaaacggggtcacttctgggcaaaaggagtggctttctgatcaggtgaaccatggctgctgggagaacaatgaaaagagaaagaggctttatagaaaatgagagagaagagaacaaagagggacctagataatggaaactctaccctttaacctcaagtgcagaagcttggccaagcgtacaataaacactggtgaggaagaaaaccatatccccagaggcagtgcctgggtaacatgagtggaatacagacagagacaagctcatgtgtaaaatacagggtgttccagtatcataactttaattatttttttcttccctactcaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccagggtaagcgggcaggcccagcctcctcccggcagtgggtccctccacagggatactggacagactcgccaagactttgaattcactcctgtgacggaagagtctggtcttttctgatctgctgctttgttctggtgctgagggtgggctgggggacctcctgataaagggaagtgggaagaaaaacttggcaaaacgggatcaaagtacatgaaagatgacagcctggtgaactattatgggaaagctggaaacttggcttttggggagatgctggccatcctgctgaaatctttagcggggttcagagatgtctctttgctcatttcctcctaaagcatgagttgtttgcagccttaggttgctgtcttgaatacagtagagctgggaaggcagtagcttggagaactggtaccagccttttaaaatcctagttccgattattggtagttatgacaaaggaagcctttgattaaagtctgtgaacttacatgtgggaaaatgatgagcaattctcaaagcaaaaaggaaaagccgtatattaccagtgaggtttggcgatctatagcagttgtttcttttggctttcacaacatagcttggccctcagctcttgtcctcctaatagtgagcaggaggaccaaggcacaagaaaaaaaaaaaaaaaaaaagggaggaagacgctggtgtaatctcttagggctcactaaaggacagacacactcaggcggctcatgtagcactttgcttatttatctcatcactgactgtaactggcttaagtggtttccgggacccacactgataaagtttgaggttgcctcatatcaggagaaggtagcaggaagaaatcctttggcttcttttaaataactgttttactagatgaagttttcaaaatgcatgttcctgactttactggtaattacgtctctgtacctgcactttttaagctgtgaaacagaatcattcgaaggctcagaggtatgtgacttccttagagccacttaggctacaacacctacacgctgcacccacagacacacacacagagcagagcacggatgcaagtcatctttcagaaatgatctcaagtatttgatttttttaagagaatgtacatatttattatgaacatttacctgatttattctaataatttaccccattcccacatctcaagtgtaggcagatagtctgaccatgtgaatgtgagacccaagttcccaacttatctctcacagaaaacccacatacacattctacctggtttctggcattctctatggcctggactgactgactgggatttttctaaggccaggagagaactgtccagccagtgatataaacaagcgggtcccatgtgtcccaagggcacttcccttcagcaacttcagaacacccatttagacgatcacagttggccaggtgcagtggctcatgtctgtaatcccagcactttgggaggccgaggcaggcagatcacttgaggtcaggagttcgagaccagcctgaccaacattgtgaaactccatctctactaaacatacaaaaattagccaggcatggtggtacacacctgtagtcccagctactcgggaggctgaggcaggagaatcacttgaacctgggagttgaaggttgcagtaagccaagatcactgctcaccagcctgggtgacagactgagactccatctcaaggaaaaaaaaaaaaaacaaaaaacctctagatggtcacatttgcctggagcttgcctctgttccctctgtccacttccaaggacccctcctggccacatctgtccacataccctgcactgccataggctcacatgctcagaaccctccttagctcatccacaaacactcttcggagctagctattgtagctgttgttacccctcttggagtggaggtggagtggggaccagagacacccagtgactttcttagcgatgcacagcacttagggccagagctgaggccagaaccttggattccgtattcctaaaatggcaaagcttgcttgacatcagtggtttccaaactttttcaatccagctttcttccaactatttatccaatgatccagctttttaaaaaactctctttaatccaatgagatcccatgaagaagagatcaaacactgaagttcactcactatctcttctgcacgaggagctccagccgagccaagccattctctgcacactccaagcttggccctgcctcagggctttgaagcttgctgccttctttgaccatccaatctatggacatcaccatcatatcaccttcttccgagcagctatgatctgaaattgtctaatgtgtgtgcacttttctgtctctgtccatgggcttataaactccacaaagaaaggacattacccatctattccctgttcctggcacagagccggagacagtcagtaaatctgagctgaatgaatgaatggttgaaagggagtctcctcccattgcctgcctgagtactcgttcagtgttcaaaggaacacaattggaaaacatggccctgtattatgaatgatgataataatttaccagctgtaggatttctttttttgaaacagggtctctgtcacccaggctggagtgcagtggtgtgatctcagctcactgcagcctccacctcctgggttcaggtgattcttctaccttagactccccggtagctaggattacaggcatgcaccaccacacccggctaatttttgtattttttggtagagacagggtttcaccatgttggccaggctggtctcgaactcctgacctcaagtgatccgcctgtctcagcctcccaaagtgctgggattacaggcatgagccaccgcgcccggccccaactgcaggatttgaggcaagttattcagtctctccatgcctcactttcctcatttggaaaatagttgcaatagtgtcaactcatagccatggtatgagatttaataagttaacatatagaaagcagacggcacagtgcctaatgcacagtaagtattgtaaatgtatcagctgttattattaagggctggctctgtgcaggccttcttctaagtcctttgcatgtattaattaactcacctagtgaagaattgtaaataggagtcatcacagtggctagcatttattgggcgctgtactgagtgcttctatgtattatctcatctgccccacccagcaacaatgtaggataagctttttctcatgttataaatgagaacaattagaacaagtagttaagaataatttggctgatgcctcatgcttagtaggatgtggcacaagaactgaacccaggcctgtccacagaggctgtgctttcaaccactgtaccttcctcccactgtcctctgtcccaaccctccttggctctgagcttccttatattgagagctgtactggaacccacggagccttaaagggcttttctttttttgtttttgtttgtttgtttgtttgtttgtttttgagatagggtcttattccccttgcccaagctagagtgcagtggcatggtcctaggtcactgcagccttggcctcctgggctcacatgattctcccacctcagcctcccgagtagctgggactacagtcactcgccaccacacccagctaatttttgtatttttagtagggatggcgtttcaccatcttgcccaggctgatctcgaacttttgggctcaagcaatcctcccgcttcagcctcccaaagtaccaggattacaggcatgagccactgagcccagcctccacacagaagctcaactctgcagaggaaagagaaattgagagagagagaaagaaaaaagacttaattacttcagtctggactgtattttaaaacttacttttttaacagtttggcccaaagaaaagtacattattataggcaaatataaagtcaactttcagagtaaatgctttctattttgccaaagttctgtcagtctccttccagcataaaattttgttttcctgcaaaatttttatatctaattctatggagccaatttttattggcaaaataattaatataataaagaatgaaggaaacaaattaagagaactgggtcttggggaaaaaatcaaatacagtgacagtatgcggtgggcagggcactgttttgaagcatgtgaggagtgacatagaccctagtggatgttagccaaatgcttgactagaggagcgagagtgactaatttttcttttatacgtttatattcgaaaggaagaggcatgtaagcagttaaccacttatcaggaggaagggcttagcatggggtctgggcaaggattttggaaaagttcaggtttgaaaatttgacagagtgaaccctgccaagtggacttgcctttaataggagttaatgtaataattggcctgggagttttaaccaaaaaagtagaggctttgaagtgttggaaacgaaaagaaaatctcatggcagttttattagctcatatgatcagcaggagatgataaacgataaataggtctagggccttctgcggttggcaaagacctgaagtttgcaaacaattgagagctctgcccagcagcctggggtagaaccgagcggtataaattgtcaagtcatagatactttgaatgaaataggaggctgaagtccttctacatctgagattgttggagctggaagggatcttcagagtcttctaagccattcattttggacatggggagacttcccaggggagctgggatccagatgtgctgcctgtccatccatgttgctcccctgcacctcccattcttctccatagcttagccttcccaaggccccttgccactgctccctccccacctcgtgcctaccctgccttgctggggacacaggagagaactgcccagacctagtgtctcctggaatcctccatgtgtttaggcttcgatgtgctttgtacagagtttggctcctgtaaaaatttgggcagggaaattgatacccattctcaggatattttcccctgagctaaggaagggtttcttcatcctgtattatttttcccctgtgacctctcagaggtcacagaacattgatggaaaaatgtgagtagtccaaaatcaagagctcacccagaaccagcaggggcaggacaaggaaccgcagtcccaggtggtctattgacttatctggatggcagcatcctgttgctgttcaagacacatcagcaaatacatatgcggattcccaggtgcagattcttcccacagcgctttgtgcttccctccatgacagcgtttactgtattatttcatattattttatgattatttgtttctgcctctgggtctctcaccagcctgaagagctcagtgcagccacttcagcaccaggccatagtaggcactcaggagaggtggcttgtgctgggctagtctacaagggacataaaattagaccctgccttcaaggatgtagatctgggcagggtatcatgagctcatcaaaatttaaaacaataaaggcttaaatatattaataagttcagggatgtaccagaagctcttggagaagctcgccattaattgccaaggtatcatccacagaccagcagttttcacaatgctccacggaggcctcggttgaaatagagaagtctcaagggatggtggagcttgggccaaaggcttctggacctgccattcccaatgtgcacgtacacacacacacacacacacacacacacacacacacacacaccctagcacagagtctctgtgttattgttttctacctatttaattatttgggcttcattcattccacaggtatttgttgagcaccttctgtgtgctgggcactcttgtagacaccctggacacagtagtgaaaaaagattaaaattccttccttcatagagcttaagttccagcaagaatgttcctttcaaagtttcttttagaaaaaaagctcatgttgcatgacaaaaagaaggatattgcaaaatgtgtctcaaagagatcctaagaattctaggaaggtgcagtgagtaagggagtcacaaaaacagaaaaggcctttcagaggaagtaggtttgaactggatctgagcaggatgaccacgtggccgggcagagaagactggggaggcgaaggcattgaggtcaggctgagccaggtgtgtttaggtgccagtgagtaaacctacttggagggacctgatgtctggaggggggccagagagatgggacttggggtggcaggctgggccactccatccagggcagtgaggccttcaggaaagcagcgaaccttgtaattgtgtgaactgagtaaagcacatgcgctatttggagagtctttaagagtgaaagtttcaagctttggaaatgtagggcgatccctctggcaccactcagctcagcgcactccacacttcattgagggtcatggccatggtctcctgtctgcatttaggatggggagatttactactgctttcgacctcttatcaataaactgccttgagggtggaggacgggcacagctgcatgcctggagggtgtggcctggtgaatcgctgctctctggcccccccacctattgtcacccttctctctgcagcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcaggtcagcaaggcccagtgggctttcctcccaccctccttctctggccctcaccccaaacttccttggtgccctgctcaagcctgaggtctgggttccccctattccaggttccctggtttgactgaaaaatgacagttgaaggagttttgtgattttgttttttgagacagggtctcgctctgtggcccaggctggagtgcagtgatgcaatcatagctcactgtaacctcagccacttgggctcaagcaaccctcccacctcagcctcccgagtagctgggactacaggctcatgccacaacacccggataatttttttattattgtttttgtagaaatagggtctctctatgttgcccaggctgacctcaaactcctggcctcaagcagtcctcctgcctcggcacccccaaagctctgggattacaggcatgagtccccatgcccaccctgtctgagtttttaaatagagatgttgtgtgtgtgtgtgtttcaggtagtttttatggaaaaaattaaacttacattcttaacctattctcattttacaactcactcaaaaaaatcataaattggcacccatcctttttttctataacacaataacttacattttctgagtgctttacagtactttttgttttgttttgttttttgagatggaatctcactgtgtcacccaggctggagtacagtggtgcagtttcagctcactgcaacctctgcctccctggttcaaatgattctcctgcctcagcctcccaagtagctgggattacaggtgcacaccgccatgcctggctaatttttgtatttttagtagagacagggtttcaccacgttggccaggctggtcttgaactcctgacctcaggtgatccgcctgcctcggcctcccaaagttctgggattacaggcgtgagccaccgcaccctgtgtggtagagtacttttacagatatcatttcattttattctgatggcccagggaaggataggcattgttgtgcccactttaaacagatgaagggactaaagccacaaatggctaagtgacatatccaaattagtgaagtagctctttgggtgaggaaactggccctgaccttgaatttgggccttcagacaccaactccaagcctgtttcccttcatcatgctgcctcaagtttgttggtctttttccagtttctttatatggatgtgtgagttcaacaagttctgttcgtgaagccactaatatttagatataaaatagagccctggtgccaagcagttattgcatctccctggaaatgatcactcaagtctacagcaaagaaaagattaaagttgtttactgagatcacctaaactttaaaggaccatccagccacagttgagtaaaggtcactagtaacatgtcaccagccacctggtttttttgttgttgttgttgttgttttttaagcttggttaaaagctactgtttaactgaggagagctaagcaggtacttctttatatagtgacagttttccttcctggctattgtagagctgaaaagagggggaaagggtgagagtaaaccttttcagaaccggaaaaccacaagccatcttcttgacaaactctcctgtcatttcctttattcatttgattttttagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaaggtatgtgtctcagaggtggctgccacagacccccagcccagcccctaagagccaagagtgccagccagcatggtgaggccagcgcctttccgcctcttccccatcacagcccccagctgaaagtgagggtaaactgattcagtgcctgggagggtgggggggaaggacttttatagacctccattttcttcactttcttatgtttacttttttctgcgttccacccactcccccttaaatcctcctctctctgtgtgtacgggtacacacacttacacatggaaacacatagcttttagtttttccagacttataaaattttttcattgatgcataatagatgtacgtagtttcagggtccatgcgataatgtaattcatgtaatttgtcaagattaaatcaatgtactttgacacattcataaccttaaatatttgtcacttatttatgctagaaccattccagttcttctcttctggctattttgaaatgttcagtagatttttttttttttttttttgagacggagtctctctcactctgtcacccaggttggagtgcagtggtgggacctcggctcattgcaacctccacctcccaggttcaagcaattctcctgcttcagcctccccgagtatctgggactacaggcacatgccaccacacccaggctaatttctgtaatttttagtagaatggggttttgccatgttggccaggctggtcttgaacttttgacttcgagtgatccacctgccttggcctcccaaagtgctgggattacaggtgtgagccatcgtgcccagcctgaaatattcaatagattattatatactacattcacttactgatctaacagcaggtcttattccttctatcataccgtgtatttgtacccattgatccacttctctgcatccccttccttttccctttcccggctctggtaaccaccagtctactctctgtcttcatgaaatctactttcacagctcccacatacgagtgagaacatgcaacatttaggcctggggcattattgacagagaattgttgctttgaagttggaaaatgccttatggtgctaaaagccaaagagaggcctctgagaacttgaagctaaccatgtgttcctttccagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgcca

SEQ ID NO: 192 - DNA, 89650 bp, Homo sapiens
gcccagtcgcgccgccagcgggctgagggtaggaagtagccgctccgagtggaggcgactgggggctgaagagcgcgccgccctctcgtcccactttccaggtgagacgctccctcgatcccggagactgaggccactgggcagccgtggaccttctcggacggctgcggcgatccattccttcccgctgtggtggtacttctggggcgggggttccccaggttaccacagcagcctcggttccttcccctcgggagactcggcccctctccctgcgccacgcgactcccggcgcccgcgctccttcgtgccccccttcccacctctgtccctagtgcgcctcggaccgctggggctgctgcagcctcagtccccgccctagggaccaggactttcttgaattttccttcccggggaggaatcactctgttgcttttttttttttccaagttcccctgcacctggtcctccctaacgaggctaaggggaacgcaagcgcggggcgtgggcttttggccgccacagccgcagatggttcgcatgtggcggtggagagcggattttaaggcttggagctggatccgcagcgcgccaggcatttttgccctatcgaaagtcgccgggagctggggggacctccccagaaagttccggctgaactcatctgttgcgcgcagcggtgcagcattagctgccagacgtagcccggggcgccgagctttctgctcgtagcgccgaggaagtaggctctcaggtcacctcgtcgtcagggaagcttccttccctcttcttccccataactttttttaaaaagagacaagagctcttctctcaatctctgtctctctgtctctctctgccgagaatttgcagcttttaaaagtccacatcagtccaacaaattccatggttgtgtgaggattttgagttggattacatggctggcccccggatgtatgtttcaatggggaggaaggatggtatgataactgtgagactctttctcctaaataatcgactctgttacatacaaattcaatgtttagacactaacatcttacgcgttccggatagagtgaagactcttggaattttgcactgttttctttaagaaagggttgaagaagcagctagatcctcttttaggaattgatctaaaaggccaaagagacttgccaatttccacttaactgtttctggtttctccgagagcagtggttctcggactttcgcttggaatgcactcggaggggatgaaatagccactacgtgaaggggggaggggcaaagacgtggcagcagcgttctttcatcaattttttactcttttttttttttttttttaaagttctggttagaaacgtatttccccttttaggtttagacgtagcttatgaatgaggctagtcttttcctaaaataatcagatgaagaattcagtctgcatagcaggaacgttggaagttaatttaaaaaacattttaaagggatttttagaatcaagtttctatggagaaaatcggtatcctaagacgatatattcaagaagctgaaagtgaacaacctcaactatattttgtcttcatgtgaaatgtgaatacacaccccgtgatttttttttttttttttttttttttttagcttgtgagcgtaatttaagaatctgaaatgtgaacttcaaattttacttttttctttatgtgggaaaagagactttatcacttacctttaataaaattcatagtcagttttggttttgggacattgtgccttaagtcctgccattgtttttgatagctgatgacaaatgtttcttagatttacatagactaactaggaaaaggactatttctgtctcttttaaatgggtagtgctgtttttattgacattttgaaatgagttttattttgaagtactgaaaatcaggactttggtaggcggataattacattggccattttgtgttttggtaacttagatggtaaaacagttgaaaaatgtgtacaacttttaattatgccaaaaaaattagtgcaaaagactattgaaaaaaagttttatattgccttgtagtctgggttgttgcagatgaatcttggctttttggcaaggagctgttaaccttttctattagtgcagaataagttgtatactgaaaagcagtgtttttcagtagggcaattaagttcaaacggcatttattccagagatgcagcaagagctgggacagccataaagcttgtgagccttcctttctgtggaaggaatgctttattttacttagcaaccagttatcaactaggatataattattgctcttgaattgacctgtgagatacataatagtggttctcaaactattttaaggtcatgaaatcctttgagaatctgatgaaaggtgtggtcctatgtcagaaaatgcaaatacaccctacatggaattttgtatgtcacttcctgcccccccactcaagtccattcatgaactttattataagaacccctaaaaagtaagagatgtgaagttactctctaagggtatctaggtgtcttgaggcagtattgaatgtttctgaaaatcgagctgggcatgtaagtctgactggacttgtatatgtgggtgaccctaatacatttttgccaaaagggttttaacaaaagttaataggttgttagaattgttgaaatgctaaattgtctagtctgtgaaagtatatcacattgcatgccctctcctatatatggtaacttaactttggttttccattctgaaagtggaacaggcttggaagtaaacaaaaataaattgcataggctcttggcattaaactttattgcttttcttgcagtgagatcttgaatcttgtaattaaaccataatgtgttgtgtgtgtataaatatatgaatatatataaaaaatccaaataaaatgagtatgtgtgtgtgtgtgtgtgtgtatatatatatatatatatatatatatatatatattttttttttttttttttttttttttttttttgagatggagtttcactctgccacccaggctggagtgcagtggtgcaatctcggcccactgcaagctccacctcccgggttcacgccattctcctgcctaagcctcccgagtagctgggactacagccgcccaccatcacgcccagctaattttttgtatttttagtagagacggggttacaccgtgttaaccaggatggtctcgatctctttacctcgtgatctgcccgccttggcctcccaaagtgctgggattacaggtgtgatcacgccaccgtgcccggccaaagctttgtgtttctattcaagaaaatttatttgtataaattgaagctgtcctgtcattaggacagcttcagtttctctagttgaataagtattgtacctaaagaaaagctttggcaattcaaaaggactctcatttaggttactccagcagtttttaaactcggtgtggtgaaaaacattctttttcctggtcttcctttggatgatcagtatgactgttagtatatttgatttgacatttgctaaaaatacattatagagattcagacttcttacctagttgtcatcagtgaatgagttctatattgggcctttctcttcctcatgtttagtgtttcataaaaatgtgtccatattactcatttctttcttaaatagtaatattatgtggaattagtacactcagccttactctctcttttttttttttttttaagagataggatcttgctctgttgcccaggatggagtgcagtggtgtgaccatagctcactgcagccttgaactcctgggctcaagcaatccttctgcctcagcctccgggtgtagctcggggtacagatgcatgccaccatgtctagctaattttttaattttttgtagagatgggatcttgctctgttgaccaggctagtctcgaactcctggcctcaagtgattctcccatctgccccacaaagtgttgggattataggtgtgagccaccatgcctggtcatccttactctcttgttggacacttgagctgtttctccattataagtagtgcaaagagaggactgtaatttagtggtttattttatcaacctgtataattacagtaaactttaaccaattttttaatttttaaatttatatttaaatttttttttttttagagacagggccttactatgttgcccaggcatggtggctcacacctgtaatcacagcactttggaaggccgaggcaggaggatcacttgaggccaggagttcaagaccagcctggtcagcatagtgagaccccatctctctacaaaaaaaatttttttttaattaagggggcatgaggttgcatgcatctgtagtctaactacttgggaggctgaggtgggagggtcgcttgagcccaagagttggaagctgcagtgagctatgatagcaccattgcactctagcctgggtgagagtgcaagaccctgtctctaaaaaaaaaaaaaaaaaaaagaaaagaaaaaaaaattatttacaatatggccagtagactgtaggaaaatcaagaatgatgagaaatgtttcataggagaagtaggacataaaaattacatgatatagcaccatgtggctaacattttactagatattaaatctgtagcactgaatggaaatgcatatctagattcacatcctctacaaccatgaattcatttttccctgttctagtatacatggtcttattttgtctctctttacctcaacttgagaaatttggatctggcattagagtaaacagataattgaagactagaaagaggtagactgggtggaaataaaagtggaattttgacagaatagccttgggagggatgaagctgagtatacctgggcctcagagcaataatccattttttaggaggaaagggactgctaaagccagcttttgagtattctactctgacctgagtggccttggtctgaatagctcatgttcagagataagagtatatttaacttttttgtactaagaatagtatttgagtaatgttataggtacatatgagaatttggccttcatctctgccgagtcagttaaacacaagtttctctagatatttccattacaagaatcaaagctctttgatttttggaacttcagtaaaacccaagaatgaatagccgagaactatcatacaagtcataaaattaaaaggcattgaacagtgtatgaagcatcagatatcctgttacatgtgtctgcaacaataaattaaatattgattaactgattttaagtaggctcaagacttctcttacagttctaatcttatattaactagatttgcatatctaatttctccaaaaatatgatcaagaaatgtttattttagtctaggcgtggtggctcacatctgtaatcccagtgctttgggaggctgaggtgggaagatctctggagcccaggagttcaaggctgctgtgagctctgattgttccactccactccagcctgggtgacagagccagaccctgtctcaaaaaaacaaaaaaagttggtatttctaaaacctactggttgaatttaggacctcaaaatgttacttgtgtgtgtgacctttgttcttgccctatggttctgacaaccttcctcctttttatttatttatttatttatttatttatttttttggtaaactcaggcaacatattcatagtcaaaggttacatgaagacattctcaaatttacatgatttcaaaatttagttacttcttttttttttttttttttttttttgagatggactctcactctgtcacccaggctggagtgcagtggcgcaatctcggttcacggcaacctctgcctcctgggttcaagcaattctctgcctcagcctcccgagtagctgggattacaggcacccgccaccacgcccgactacttttttgtatttttagtagagacagggtgtcaccatcttggccgggcgggtctcgaactcctgaccgggggtgatccatcagcctcggcctcccaaagtgctgggattacaggcatgagccaccgcacctggcctgcagttacttcctttaacctcaaagatattttgaaaatagacctcaatttactatgcctgaatttaaaaaaccttaatattgtatttgaaaatagtgaatagtgaccattgccaccaagtagagtgatagtaataagtaaaacactaatctttgatataagggtgattactaataaattgaataaactgatatattttaacgactttattgagcaaaattgacaggacaaattgcatatatttacagtgtacaatttgataaatttgacaaaaatatctacttaaaaaaatatcagtacaatcaagataaggaacatatccatcaccttcaagagtatcctcaaggtcaggcacagtggcttaggcctgtaatcccaaccctttgggtggccgaggcaggaggactgcttgagcccaggagttccagaccagcctgggcgacatagaaagacttcatctctacacaaaataaaataacattagctgggtgtgatggtgcctgcctgtaatcctagctacttgggaggccgaggcaggaggattgcttgagctggggaggttgagtcttcaatgaactgtgattgtgctactgtactccagcctggtgaccgaaatgagtctctgtctcaaaaaagagtatacttggccaggcgcagtggctcacacctgtaatcccaacactctggggggccgaggcaggaggactgcttgagcccagaagttcaagaccagcctgcgcaacatggtaaaaccctgtctctacaaaaaaattaaaaagccaggtgtggtgttgtgtgcctgcagtccccgctacttgggagactgaggtgggagactcacccaaagcctggagattaaggctgcggtgagccaagatcacgctactgcactctagccggggcatcggcagtatccttatgactttttgtaatcccttcttttgctccttactaccctctctgtatccctaggaaaccattgtttcctttctgttgcttaagattagtttttattttctagaattttataaaaatggaattgtatatacgctttttttttttttttttagcacggggaatctccttacactcagcataatttgagattcatccatgttgttatgtgttcatagttttttattgttgaatagtattttattttatgaatataccatgattttttttaacccatttaccctttgatggacatttggattgttttcactttttgactattatgaataaagctgctatgagcattcatgtacaagttgttggagagagatatgctttcttttctcttatattaatgcctaggagtgcaatagctagatgtgatagggaaatattttttcccagttgttggcttgtcttcattctttaaacagtgtgcttcaaagagcagtttctattcacagacaacatgtctgtgactcttcaaaaaagctctagtgaataggttaattcagcagagttgtagcttagaaggtcaatatacaacagtaaattgtatttctatatactaataatgaacaattagaaactaaagtgaaaaattcccatctcattagcactaaaaaccatgaaatacttaagtattaacttttcaaatggtgtgtaatatttgtatgttgaaaattatgaaacactgattatatcatgttcatggattagaagactcagtattaagatacctactcttctcaaactgatttatagattcagcacatttctagtccaaatctcagaggatttcttatagaaattaatgagccgattctaaaattaatatggaaaaccaaaggaactagaaaagctaaaacaattttgaaaaagaataacaaagttggaagattcatactacctgatttcaacttagtttaaagctgcaataaccaagactgtggtattggagaaaagatagacatacagatcaattgaacaaaatagagaatttagtcacacaaaaattgtcaattcattttgaaaaagtttaagggcagttcaacagaggatagtctggaacagttgaatattcatatgcaaagaaaaaacaatctttgttttatttgggcaccaagtatccactgttggacactgggcagtcccttgcccaggaatttatgtgaatattgggacaagtgacatgaatccaccagtggatatgaaataaagtttaatcacacagtaaacagcaaaaggactcctcaaggtcaaggacttaggtttagtccaggatgaagcaagagtgaaacagggtgggtggctttggtttttattgaccagaaggtggaacttgtttgatggtccccatgtgtggtatttacatggtttcaacttcacaccagtaccaagggagggaatactggtccccaagtgtggtatttatatggtttcaactttacaccaataccaagggagggagtacctgggctttcttacagacttacccagatgtgggacaaaagggagagaggtgtgggacctgaaggcaatctgcactcaaacatcaaaatgaaatctttttattagagcctcaatctgtacttgacactgtatgcaaaaattagttcaaaatggttcgtaggccgggtctggtcgcacacgtttgtaatcccagcattttgggaggttgaggcaggaggattgcttgagcccaggagtttgagactagccttggcaagagtgagacccgtttctattttaaaaaatgttcatagattgtgaagtaaaatgtacagctataaaatatttgaaagaaaacataggacaaaaatatttttgaccatgggtcaggcagagatttcttggacatgatgccaagaacatgattcataaatgaacaaactgataaattagacttcatcaaaattaagaaattctgctcttccaaacacactgttgagagaataaaaagacttcacagactgggagaaaatattccccatcacatatctgacaaaaaatagactgtataaggaactcaaagctgggcatggtggctcacgtctgtaatcccagcactttgggaggccaagactggaggattgcttgaaaatccaggagtttgagaccagcttgggcaacatagcaagaccccatctctattaaaaaaagtaaacaacctaattaaaaagagcaaaagatttgagtagacactatgcaggaaggtgtatgaacagcagataaacaccccaaaaggtgttaaacataggccaggcatggtgggtcatgcctgtaatcccagcactttgggaagctgaggtgggtggaccatctgaggtcaggagttcaagactagcccggccaacatagcgaaaccgtctctactaaaaatacaaaattggtcaggtgtggtggcacgtgcctgtaatcccagctacctaggaggctgagacacgagaatcacttgaacccaggaggtggaggttgcagtgagacaagattgtgccactgcattccagcctgggcgacagagtgagactctgtctcaaaaaaaaaaaaaaaaaataaaggcattaaacatcattagtaattatggaattgcaaattaaacccataatgagatagtactatatgtctattgtgaaaattaagatattaagagaaactaaggaaaaaacggcaatacaaaatgctggtaagaatgggagcaatggaaactttcatcctttgctgttggaagggcaaatagtgtagctactttggagaaacgtttggcagttttttatgaaggtaaatatatacttgtcatatgacccaacattcccgctcctaggtatttacccaagtgaaatgagaacttaggttgatttcctcttttttttttttttttttttttttttgagatgcactctcactcttttacccaggctggagtgcagtgacacaatctcggctcactgcaacctccacctcctgggttcaagcaattctcctgcctcagcctcccaagtagctgggatttacaggcatgtgccaccacgcctggctaatttttgtatttttagtagagatggggtttcaccatgttggccaggttggtcttgaactcctgacctcaagtgatctgcctgcctcagcctcccaaagtgccgggattacaggcgtgagccaccgctcccagcctgttttctttttaatttttttaaaacagttttattgagtaataattcacgtaccatgcaattttccctttaaagtatacatttcagtggcttttaatatattcacagttgtgttaccacaacaatcaattttaaaacatttatatcactccaaaaagaaaccccagagccagtagcagtcactcccattgtcccttgcctaaccctgggcaaccactaatctactttttgtttctagagattattttacttaatgttttcaaggttcatttgtgttataacatatatcagtacttcatttctgtttatagccaaataatattccattgtacggatagaccacactttgtttacccactaatggatatttgggttatttccacccttttggctattatgaataatgctgctgccgtgaacattcatgcaaaagtttttgcctgggcatgtgttctcatttcttttgggtatagacctatgagtgaaatatctgggccatatggttattctgttcagcttttttgaggaactaaactgttttccagaccaactgcctcattttacgtttttaccagcaatgtatcagagttccagtttctctgtgtccttgtcaatacttgtaattgtgtgtcactttttgttttaaagagatgaagtcttactatgttgcccatgttggagtacagtggccattcacaggtgcaatcatagtgcagttatatgctcaaactcctagactccagtgatcctcctgcctcagtctcccaagtagatagaactacaggcgtatgccactgtacccagctagtcattttttactgtagccatcaaagtggcagtgaagtggtatctcattgtggaattgatttgcattttcatagtgatgaatgatgttgaacatcttttcatgtacttgcctctttggagaaatgtctattcaaatcctttgcccattaaaaaaaaatcactggccgggtgcggtgggtcactcctgtaatcccagcactttgggaggctgaggtgggcagatcacctgaggttgggagttcaagaccagcctgaccaacatggagaaactccgtctctgctaaaaatacaaaattagccaggcgtggtggcacatggctgtaatcccagctactcgggaggctgaggcaggagaatcgcttgaacccaggaggtggaggttgcagtgagctgagattgtgccattgcactccagcctgggcaacaagagcaaaactctgtctcaaaaaaaaaaaaaattattgagttctaagttctttatatatttggatactaaacctgatgctatcggaaatgtgattcgcaaatacttttttacattgtcttcgctttcttgaagcacagcagttttagattttggcaaagttcaatttatttatttctttggcttcttggtgctttaggcgtcatatctaagaaactattgcctaggcgttatgattaattgcctaatccaaggttatgaaaataatttttttttttaaatgagatggactcactctgtcacccaggctagagtgcagtggcacaatcatggcttatagtaccctctgcctcctgggttcaagcaatccttccacctcagcctcctgagttgctgggactataggagcatgccaccatgcccggctaatttttttatttttttgtaaagactgggtttcaccatgttgccaaggctggtctcgaactcttgagctcaagtgatccttccatcttggcctcccaaagtgctgggattgcaccttggtggcatgagccaccaagcctggccagtttattgtcttaaacttcaaaatggtcttaatgtgttaattttagggtaaatttacagttatcttgtttattcccaggtaattaagtgttgctgttgcaaatgagctttttaaaattgtttcctgtgattggttattctttgtatataacggtcattttctaaagagaatgccagtttttttccccaaatggtcatttttcaagtagtataactgctatataaaattcaatcttggtctgggcacggtggctcacatctgtaatcccagcacattgggaggctcaggcgggaagactgcttgagactagcctggaggtggagttggagactagcctgggcaacataaggagatcccaactctacaacaaataaaagaaatttaaaaaattggccggtcgtggtggcacaagccctgtagtccaagctactcaggaagctgaggtggaaggatcacttgagccctggaggtcgaggctgtagtcagctgtgattgctccactgcactccagactgggcaacaaagccagacccccaaacaatacaattagtcttgaatgaagtttcatgaaaacttctgaatttggaattgtttgccttacttaacttcataatttatatttaagtttaagaaatctaaagtgcatattgtacaaaacttttaaactttttacttgtatccttagggtggtgaaaaaaccaaagctgtcttatcagaacttcttgtttaaatcaaaaataggtgaaatttgtttgggaacaaaagggattgatggtggtattatgccagctagaagcagagctgtggaattcatcatttgggattttgctaactctatgatttatctatttacttaaactttgtttttttgttagcttgtttatttacagaaatagaatttttttaaattaaaaatgtttatcaaagaagtgtagatgttgagggaagagaaaaacaactgtgattccacctctcatttaacatttttttgagttcttttaattattgtattaaatttaaaaaacctgttacatatgtaggcaaatatattcttttttttgagaccaagttccactctgtcacttgaactttatgtagttcaggcattcagaactactagaactttgaatagccatttggttagggataagcatcatgctgtatggggatgaattaaaggtagaatagagtgccagaaaaaggtaaaaggggtcagtttcttgaagaaagagaaaaggggtggaggaggtgtcataagcaaaacataagtgtgtgtttttgaaatgatctcatcttaacgttctttctgacaggaaagacttaggactttggaagaacttccaaaagacagcctgtgtagcactttcagttaagggcaatatcttaacttagagctgacttctaatatgaatcttgaaatgcttttcatttggaattatgccaataagtgctacaatactgctcagtacagttcactaccctagtacagaaagtgagggaaagaagctagcgtgatttctgaatttgtgatagaaaagttggtcatagcattaaagtatttgtccatcagattgtaagtactagacatgtagctcactcttcttttaagaacagaagtatgactggaattcatggagttaagtaaaaacaatggcaatttgcagagggattatagggaagaacagaaatataactaattctattagtaattactcttacttgtcttggaagatacatcctgttaagatggaaaagacatgccaagttttgacataatctgagattagtctttcttttaaaggagattgcatccattttgacccattaatttctttttcaagcttgtttgaatatttagaacaggaggcatttatattttataatttttgataaagtcataatgtcttttgggatacttgactcttaaatgttctataatgattctctttgcaagctgctttctgaatgaaggtagaataaatagaagtgagacaccataagcacattataatggcctgatttaggagcctgaatttgtggtgttcttttgtgttgaccatgaaaactgtcagaaacattaaaagtctgaaacagatttcaggaggaccaacagttgaataagggatctgtatgaggaaaaataaagttggagccttctaaaagaaggtttggaacaagtgtcgaaggttaaaagaacccctgtggaaaattttaagtgtcagagaaagtttagtttagaatatcaagcattcttggctggaccaagtgcaatggtgtttacaactaattgatcacaatgagttacaggtttctttgttttttctgcactcccattgctttacttgactagcttaaaaaaagagaatatcaagcactctttagtctgccttattaatttttgaatgatttgtctgggagatataaacttttgaaaattttacaactttttcttggaagaaaaatatttgaccaaaacgctaatagaattatttaccagatgccctgtcctagtaattcactggataacttgtacttaaaattcaatgactcctcataactcaatgtaaatatagatgctccttgacttatggggctgtgtcctgataaaccaactgtaagttgaaaatactgtaagatgaacatcatagcttagcctagcacaccttaaacatgctcaaaacagaacacttaaattagcctacagttgggcaaaatcatctaacaaagcctattttataataaagtgttgaatagctcatgtaatttattgaatattgtaccgaaagtgaaccacagaatggttgtggggtcaaagtatgttttgtttttgttttgagacggagtctcgctctgttgcccaggctagagtgtggtggtgccatcttggctcactgtaaactccacctcccaggttcaggcgattcttctgcctcagcctcctgagttactggaattggaggcacacgctaccacgcccatagtagagacagggtttcaccctgtttgtcaggctggtctcgaactcctgacctcgtgatccgccagcctccgcctcccaaagtgctgggattacaggcgtgagccactgtgcctggcccaaagtatgttttttattgaatggcatatcacttttgcaccatcataaagttgaaaaatcctaagtcaaactgtcctatgttggggatcatttgtatttactatatggtagaacttttaagatctgttcccaggtttgattgacctgttgagtctgtgggactggacttccctggaataagaactgtaggaaagttttgtgtttggatgaatgtaaacttcacatttatttttatccaggcctacctgaaaatgttttctggtaggatttcttccatactgctttttttcttatagtttaaaaaatgtaatatgctaccaaacattataagtaatatacatgtatgttacaaaaattatataataaacacttttgaacctatctaaccaataacctaaatattatcaataacttattcatactgttgcaacaccaagttttattccagtgtaagtttatctttggatctttgactcttcttgggttttcttttctttcttcctcctattcctcctccctccctcctctttgtctttttaaaaattaagacaagtcttttcagggatgctatctgagattagtctttcttttaaaggagattgcatccattttgacccattaatttctttttcaagcttgtttgaatatttagaacaggaggcatttatattttataatttttgataaagtcataatgtcttttgggatacttgactcttaaatgttctataatgattctctttgcaagctgctttctgaatgaaggtagaataaatagaagtgagacaccataaggaaaccattgtttgttttgtttttgtttttgagatggagtctcgctctgttgcccaggctggagtgcagtggcgcaatctcagctcactgcaacctccacctcccgggttcaagtgattctcctgcctcagcctcccgagtagctgggactacaggtgtgtgccaacatgcctggctaattttttgtatttttagtagagacggggtttcactgtgttagccaggctggtctcaaactcctgacctcaagcaatctgcctgcccgcttctgcctcccaaagtactgggattacaggtgtgagccaccatgcccggctagaaaccattgttaaaaaaacctgtgattgatacgtttggctattaacatgtcacttaaagtttctgaatgaatgtggatgaatgagacatagtgctaaaacagattagagaaccattctctagagtaattagacattcagttgtacttttacataagataaattgaagtaaaatctattttaaatgcagaggtgatttcatagggttgtttgctgtatccagtggttctcagactgtgatcccccagccagcactatcagcattgcctggaaacttgtgcaaattatctcgacttttcagacctttaggtgattctgatagagctaaagtttgagaagcactgccatataggtctatcttcatttttattatctagcttgggtaggcatgttagtttggaataatgttgtatgggtctgaacttcctattgtaagtgacagaaatccaacttgaattagcttaagcaaaaaggaatttaaaggctttcttaggtgggctgggagattattgtagtagcttacagattcaaagcaatagttgcaaagaatcagggccctgggggttgaaactgtttgtctctgtatgactttgtcctgtttatagatcctagacaagtgagaaagatggtcacaggagagccccaagttcacatcctctgagcttagcaactccagaaagagctgctttctaccattcacaaggccatccctcaaccgttatgttaatgagaatgaaagtcaatgattgacctagtctgggtcttatatctaagtgtaggaggaaatagaatgggaaagtgtgctactttggcagcctagttcactgctagataatagggttgctttcaaagtatcgttatttttatttttattgttatttatttatttatttattttgagacaaagtctcactcttgtctcccaggctggagtgcaatggcgagatctcagcccacaggaacctccgcctcctgggttcaagcgattctcctgccccagcctcctgagtagctgggattataggcgcctgccaccacgcccggctaatttttgtatttttggtagagacggggtttcaccatgttggccaggctggtttcgaactcctcacctcaggtgatccatccaccttggcctcccaaagtgctgggattacaggcgtgagccaccgctcctggccttactgttgtttttacgggtatagagtctctgtcacccaggctagagtgcggtagcacattcatggcccgctgcagcctctacctcccaggctcaagtgatcttccagcctcaacctactgagtagctgggactactaccacacctggctatttttaaaaattttttatagagttggggtctccttgtgttgcctgggctggtttcgaactcctggcctacagtgatcctcccaccttagcctcccaaagtgttgggattataggcatgagccactgcacccagtttaggcttaagtatctttgaaaaagagaaagtgaaatgtagaggcttatagaactacaagatggaacatgctcaaaaccttatattatttgttagctactcttttgttagagagtaattaactacttctttaaaagtttagggtatcttaatatgagagttaatgctttaggtttattattttgtacgaagttaatttttttgtcactataaaaatatattataggaggtctggaaaatacagagatataaaagaaaattaccagccgggcgcggtggctcacgcctgtaatcccagcactttaggaggccgaggcaggcagatcacctgaggtcaggagtttgagaccagcctggccaatgtggcaaaaccccgtctctactaaaaatacaaaaattagctgggcgtgttggcaggtgcctataatcccagctacttgggaggctgaagcaggagaatcgcttgaacccgggaggcggaggttgcagtgagctgagattgcgctactacactccagcctgggcaacagaatgagactctgtctccaaaaaaaaaaaaaaaaaaaaaaaaaaaattacctactgctttgctaaccagagacaattacactttggtgaatttcctctgcatatgttcttgcatagttatgactgtattatgatgttaatttttcttcgttttgaccagtgttaatttatttataactttgtgttggggtaatgaaaacataatcttagtcaatatagattccaccaaggttgtatgataatttttaaatcttgttttttcatttaactctacaagttaaaggatgtgttcattttaagtttcttggcatataacaacattaaataattttgcttgttaattgttcacttgatgggcaaaaatggtttcttattttgtgtcattaattactaataagtttgagcattttttgttgagctaactacttttcctttttgtgagttccaagttctatatctacttgtctattaacatcttagtggttttcttattgatttgtatgaactccttaaaagtgctctattttctttaaatggttttctagtttgagttttaaaggtttttttttttttttttttgacacataagcttattttgtgtattcagattccatctggcttttgataggttgttttctttctctcttttttttttttttgagatggggtctcactttattgcccagactggagagcagtgacaagatcatggctcactgtagcctcaacttcctggtctcaagtgatcctcctacgttagcctcccaagtagctgggaccacaggtgtatgccaccgtacccagctaattttttgattttttttttttttgtagagatgaagtcttgctatgttgcccggcctggtctcaaactcctgagctcaagtgatcctctttccttggcctcccaaagtactgggattacaggtgtgaaccactgtgcccaggcattttcttatttttaagtttagaaattctctgcttttagagatctgataactattctgttgttgctatttgttttactttgttttgttgattataactatttaatccatcctagaattcattttgaaacattatgtaaggtaaagatatttattctttttacgattgttttgaatttttatgtaggctctgtcattcttaaaatattttcaagctattcgaagaaaaataccatcttaagctgctttttagttatttctgtaggctaatggtttttaattccttgtgagatttaaggacaatgaaagatgacaaaaaaactttagtgacaatatattttagcaatggcaaaataacctcttttctgacaaatctaaactctcttatcagagttaaaagtttagacaacatttgtgattagccttctgttaacagtgaaaacatttgtattttctgcaaatagcatttatccatgaagaaaattagaatagaagtatgtttaaacagaaaattctagactcttcttcagacagctcaggcttttcaaaaagccttgtgctttggcaggagcccaggagaggaagtgtctacatctgctacattctagaagccttccccaaatcactgtaaggtagccaaaagagcagtgtatttccttactgtgtggttctggaagtaactggaagtttgcagcaaactcgagggaggagactagggagtacttccagtttttgtggtgatctgtttttattgagattcaagttagggggcagtggggttattttttagctcttgtagaacggggagctttcaatttgaacctgagccttttggtttagctcacgtcacataggaagacgagtcagaggggcctgcacaaagagaaacaggttgacaagtcagggtaactaatgggagcctgttactggggcaaactatactgtaatgtaacttattctcctgtaaggtaataagaaagacaaagttcatgtttgtaggggagaaggagcaagagaagagtgctagcagggcatctgggaaagtgaggtaaagcctttctgttggttagtttatatcctcatctgccatgaagaatcctcactagaaaagacggtgctatcatggatatagaggaaaaacactaatgggctttgctgccaggtttaaaaaaagaaaagaggccatagacatgtcttaggctaagtttttttttacatagaacacagttgataagagaaacaaaactgaagtctgggtcctttgagagaaaatactagtttaaatggacatggctgtttattcgttttggattctctacaacttaaaaaaaaaaaaaaaacaggcacagtggtacagacctgtatttccagctactcaggaggctgaggtgggaggatgatttgagcccaggagtttgagttcaacttggacaacataacaagacccctgtctcttaaaaaaacaaactaagtcaaaccaagagaacagtgtcattgcaatataattcatataccttataattcacccatttagtattcatgattcaatggtttttagtactttcacagagtcattccaccatcagtcaccacagtcaattttattttatttattcatgttttttagagatggggtcttgctgtattgcccaagctggctttgaactcctgggttcaagtgatcctcctgcctcagcctcccaagtagctgggactccaggcacctgccactgtgcctggccagtcaattttagaacattttattgaccccaaatctacaacttttgattgaatttattttaaaaagttaagctatataggaaaaagatgggccgggtgccgtggctcacgcctgtaaccctagaactttgggaggatgaggtgggcggatcacctgaggtcaggagttttgagactgtcacacacacacatacacacatacacacacacacacacactatatatatatataaaatatatatgaaaaagatggaacaaattaggaattttaaggattaacagaaagctctgaaatatttttcctttaaaatgtattctaacattttgaaaatgtattggtaatatttaatatttaaattgataagttggtacatttttatgagaaagtcataggataggtctaaatcacagagaaaacttatttttcaggctatatgaaaaagccacctactattcaattactctaattgtaatagtgactaaggagaacaaactcagcttgaatttttaagcataaattatcaggtgataacaaacatacatttttatctaatatgggtgcgttggctcacacttataatcccagcactttgggaggctgaggcgggtggataacttgaggccaggagttcgagaccagcctggccaacatagcaaaaccttgtctctgctaaaaagacaaaaagttagctgggtgtggtggcacacacctttggtcccaactacttaggaggctgaggcatgagaatcgcttgaacccgggaggtggaggttgccgtgagccaagatcacaccatggcactccagcctgggcgacagagactctgtttcaaaagagaaaaacacaaaaaagaaatgtcatggtagtactctcattatatgaaaaacaagatagtagctattattaaacaattgataataactaacatcaattttatgggcaaccttggaatcttttactttttcatagaaataatagataaggaacttttccttctctttgtattttttaagtaatggctgcatttctctctttcttttgtaggtgtgtgatcctgtaaaattaaatcttccaagatgatctggtatatattaattataggaattctgcttccccagtctttggctcatccaggcttttttacttcaattggtaagtcttactacttgttgttttttgttggttttgcattttttaatttccattttttagtgttttaaaatcagcaaaaacaaatacagtgtattcctagagtataggtttattccctgccccctaaaaggtccttttttaataatttgacattttctttattttttattacaaaaatgatacatattgaagttaaaataatttaatgcatatacttagtctttttcagtgcacagatatacaagtaatatactgcatatatatctaatctgctttttccacttaatctactgtgaacacaagtttttttttgtatttataacttaaaaaatattttatcattattattttgaatagagacagggtctcaccatgttgaccaggctggtcttcaactcctggcctcaagggattctcctggctgggcctccaaagtgctgggattacgacaggcatgagctgccacgcctggcccataagtattatatacttatgactcttgattccagtatataaaatgatgggttctcgcatcctgttataaataacagattatttgaaacttttttagtgtggcttttattaattaaataaaaatttaattctaattagtctcaaaaacaaaggtaaggtaaaggggaactaaagaagtaaaggtaaaggtgaagaaacattaatctttggaaagtagtgttgatttgcaatttaaaaatacatttgtagatataaagacaatttgctagcacagtctaaagcttgcaaaatcaagtggcttaaaaattagaactggaacagttgattagaaaagtttttggctttattttggtttatctggtaaaaaggaagaaaagatagtctccagcatatctgattcatgccagttaaattgtctcatagaatgaaacagtctcaatcattcttattcttaacatacttgtgttgaaggatatgagtatttgataaccttcttccccttctaggtcagatgactgatttgatccatactgagaaagatctggtgacttctctgaaagattatattaaggcagaagaggacaagttagaacaaataaaaaagtaagcaaaatgtttgcttattatgactctgactcaacctggatgttttctttctcaagctaaaatattctttaagtagaaatgaaacccatttttgagtcttacaaagccagttgcaatggctaaaataggagtatagagaacaagttaggcttgggccaactttcacatggaagaatatgggttgggataagaatatggatagataccagccggatgcggtggctcatgcctgtaatcccagcactttgggaggccgaggagggtggatcacttgaggccaggagttcaagaccagcctggccaatgtggtgaaaccctgtctctactaaaaacacaaaactagtcgggtgtggtagcatgtgcctgtaatcccagctgcttgggaggctaaggtgggagaatcacttgaacccgggaggtggaggctgcagtgagccaagattgtgccactgcactccagcctaggctacagagccagactctatctcaaaaaaaaaaaaaaaaaaagaatatggatggatacaggaagctgactgatacatttttttttttttttttgtgacagagtcttgctctgttgcccaggctggagtgcagtggcatgatcgtggctcactgcaacctccaccttccaggttcaagtgattctcttgcctcagcctcccaagtagctgggattacaggtgtgcgccaccatgcccgggtaatttttgtatttttagtagagacggggttttgccatgttggccaggctggtctcgaactcctgacctcaggtgatctgccctcctcagcctcccagagtgctgggattacaggcgtgagccaccgcacccagcctgactgataaattttaaaagtattgctaatatcttctatcctcttctaacctcttagtcaagccacctgctgcagcaattttccaattctacttatcctttactcccatggttccattgtagagattatagtgatggtagcgttagtgttatttaattgatacagtttttctcaaatatgaatttatttttaattgactcatgttcatagttaatcctgacctgagaattcctgtcttttatttaatgagtagctaagtgttcagtttttcattttaagatacagtttctagaaactggatgtaaaaatttagtataagttgatttaaatgaacatgtaattgaatttgggttgggctaatttgtagtttgtaataatcagttatttggccctgggacctaagtctaaaatttttagacttttactggagggattcattcacaacttttactaagacagggaggttccatttactgtaaccatttgggagaaacaaaattaaaacaaaaagtcctatagttgtattgattctgccaagaggatgtcgctttttaaagagaccgagaccgtatacttttactttaaaaagaaactacagatatagttgaactcaaaaacttctagtcattttttttctgagcgtttcattaaattgtgtttttccctatgaaatataaatattcagtttttatgttttacatctgtagatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggtaagtctgaagagattcctgagtaaggtaatattgccaccatatgtagaaataataaaattaatgataaattcagttcccaggaaaccagttcagttcagtgttgtaactggattatgcctgggtgcatttggtttgaatagagttaatttagtcaaaatcctgaattctttgattaaaaaagaagtaatttctttttttgttgacttgttttgaaatctgcaaaagtgaatagattatttggcatatagcttcatttctgagggtaatcatttttattttaggattaccttcaaactttaaaaatttatgtctttatctgcaatcaatttaaaaaaatgttgggagtgttactataaagagaagtattagctgtgttctatctagtattttgaagtttagaattagtttgctcaatgtggacaatcaaactgaggctgcaaacagtaaaaatgagtaagtgatacaatacaatttgtagttggagcattgaaatgttttagatactttaataacagatgtagaagactaaatctggactttattaaggaggtaaagggattatgcctcgccccccgccgcccctgccctgccccgccaagaaaagaagaagagagagacggaaaagagctgagctagttgtgtagataaaatactccaagggtacttaccagtgtttgtaagcagtgaagtaaacttattatgcacagggatcaggaagccttgaaaagaaaaatatggcaagtacttgtgaatacttctttactgtgagagggaaatgcctgtgattattttctgtactgtataacaccttgggaacttttttttttttttttggagacagggtctcactgtctaactgttgcccaggctggagtacagtggcacaatggtggctcactgcagctttgaactcctgggctcaagcaatcctcccacctcagcctcctcagtagctagcactacaagcatagaccaccacgccaggccaatttaaaaatttttctttcttagaaacaaggtcttgctatgttgcccaggctgatctcaaattcttggcctcatgtgatccttccacctcagcctcccacagcgctagggattacacgcgtgagccatggttcctggcccctgaaccattttttaaaggaaatcgatatatttattctcaagtaatgaactaagttgttttataatgtgaaccttggcactttgttgttttaatctgtagtagtcattctataatgctatgagagagtatatatattttaatttttcttagaattttgtttgtagcataagagatattatagccttctataaaacttataaaacttgcttgtaaaattccatatagagattgcaactgagagttggtcgtaaaactaaaaatattgttgggaacagagcaggtcaaaactcccatgattgatctaataatggaattatactggtaaaaagccactgcacttcagcctgggcaacatggcaagactctgtctctaaaaagagacaaaacagcataaaaatatgcttgatataaactctagccctcttctagttatttgttcatttgtacattttcatttcacgcctgtaatcctagtagtttgggaggctgaggctggcagatcacttgaggtcaggagttcgagaggagcttagtcaacatggtgaaaacccgtctctactaaaaatataaaagttagccgggcctggtggtgggcacctttaatcccagctagtcgggaggctgaggcaggagaattgcttgaaccgggagttggaggttgccatgagccaagattgcactgctgcattccagcctgggtgacagagcgagactccatctcaaaaaaaaaaaaaaaaaaaaaaaaaaaaaaaaaggcctggtctcttgctgttcaaaatacgtagctggctggacacagttgctcatgcctgtaatcccagcactttgggagaccaaggcaggtggatcgtttgagaccaggagttggagaccagcctgggcaacacggtgaaaccccgtctctactagaaatacaaaaattagccaggtgtggtggcacatgcctgtaatcccagctactgggaggctgaggcaagataattgcttgaacctgggaggtggaggttgcagtaagctgagatcatgccactgccactgctctccagcctggatgacagagtgagactgtctcaaaaaaaaaaaaacaaaacagttgattataagttaatgagaagagagggaagtctcatacctaacttttattcacaagtaatgatactgatattaaaattttaaaccaattttttatttcttaaggagtgtttagcattcattcttcttggggttatatagttatcagtaattggtttgtttgatttttgcatactttatataaatcctctaagattaggtttatatattgtaaattttggttgatcaacgtcatgtttgataattaaactgatttaaatatattttagtaaactagctttgctgttgatcttaaatatatagttaatatctcttccttctccttgaagaattccaccaaactttatatatttacatatttatataatgtgtaatacatggaagaaaaaaacaactttaagagcacatattttacttaccatctgttatctggaagtataattgattgtcaatgaatgtcatttcagacccataaatgtgttcatttctcaaacttagtggatgcactttgttttcttgctgtgttatataactaaaaactcataactattatgttaggtgatctttacctgctaatacagatacaatttatataacagcgtcacagtccttaagcaacactaggcttttggaagattgaacaagttagaagtatgccaagtcttattcagtgtatttaattttttcttgttgagtatgtagaacttttcatggtgtggtagaaaataataaaatagattttgaacaatccttattaagtctctttatgggaagtttatgaggttctacagtttttttttctttgatttatctatttcaaggctttatctctaacctaaccattcagagacagtactttcctaatgatgaagatcaggttggggcagccaaagctctgttacgtctccaggatacctacaatttggatacagataccatctcaaagggtaatcttccaggtaagatcattcttccattctataaaatacctatcacctagcttctctgttgagtccattaacacaatgttagtataaaaaagacttgcattttaagattttaaattgtagtttgtttcatagccttcgaagactaaagaatcaccttccctttctcttagggcttaatagttacgggtatgcttctagcttctagcttgttactctgaaagcttgtattgatagagactaacttaagtagggaattttagtgtgtaaggaaaagaaactatcatttcaccaaatgtttttattcagaacacctaatactatttgaaagctttgtatgtaaagctataagggattgatagtcaaagtttatatgttaaataattaaaagccaagatgttttgggtatccacatatgtttaaagtgttccatagtatggaacatcctactttctgacctatttttggcaaagtcctctttttaagttacagttgctttcatgataatttacttttgccgtccctcactttttcaaagtttgtgactcattaccactactatctcctgttattgtcagctgcagaaataaaatatgttgtctgtgtcttcacattgaaattgattttctccgtaagaaaaaatcactgggatgagttgttaatcaaaatgttttcttgctcatctccctttatttgaggtgaaggtatccgttggtaaaaactaaacatggtataatagtaaataaaatttctgttaagctggaatataattccattaatttgaacttccaaaaatgtacaaatttgcaaattttcagtttctactaatattatacattataacgcttttgataagattataaccttatttttaaaattggtttcaggttttcatagatattaaatacttaatatgtgccagctattatgttaggtactggggacacataatgaacaagacatacactaccctcgccattagggtatttaacattcttacagtatagtaagatgagtgcttggatgggagaaattcaggataccatatgagcacatcaaaagaaacctattgctggacctcataagggatgtaaaggaagaattcctggaagatacacattaaaaaaattgagatctaatggaccaggaattagccagaaaaatgggggagagggagacaggagtgggtgtgggaaaagtgtttcagacagagggaacatgtagaaaggtcaaaaggagagagcatatcatattcagataactaacatgtagtttgtatggcttaatgtagagttcaagaggtgaacgcaccaggtggatatgggggtttggctttgtgagagtagtgagagctgagactagagaggtaagcagaagccatctcttggagagctttgtaagccatgtggaagagattgaactgtcctgagtgcagtgcggagctattaaaaagtttgtaagggaaatttatgatttttccttttagaaaaccattctggctgccgaatggagattgggttggggccaagggacgaagaaccagggaggaggctgttgcaaatatttaagtaagaggtggtagtggatagattatcaagctacttattagagtagaatagtagaatttgatgatgtacttgataggaatttctggcttcatcaactggatagattccatttaacaaaatagggctggcatggtggctcatgcctgtaatcccagcactttgggaggctaaggtggaaaggatcccttgagggtaggagttcaagaccagcctgggcagcatagcaattccctgactctacaaaaaaatgaaaacttagctgggtgttgtggtgcttgcttgtagtcctagctatttgggaggctgaggtgggatgtattcacactgctatgaagaaatacccaagactgggtaagttattttaaaaaagaggtttaattgactcacagttccgcatggctacggatgtcttaggaaactcacaatcatggcagaaggcacttcttcacagggtggcaggaaagagaatgagggccagcaggggaaatgccaggtgcttataaaaccatcctatctcatgagaactcactgtcacaagaacagcatgggggaactgcccccatgatgcagttatctccaccttgtcccgcccttgataggtggggattattaaaattcaaggtgatatttgggtgtgaacacagagccaaaccatatcacgggaggatcacttgagcccaggagttcaaggctgcagtgagctgtgatcacgccactacactccaacctgggcaacagagtgagacccctatctcaaaaaacaaaaagcaaaaaagaaaacatcccacctcagcctcccaaatgtgtggtggtgggtaataaatgttatttagattactatatgtgttttgtttaaaaaatgattatattcccatcaaaatggtcctgaatattatttaaccctgatttcactgtgtttagtcttaggggcaatattcattctttctcaggtgctttttatctccttgttgacttttttcctcttttatcacagttttgggctagttcttattgacttttctttcaggcaaattccttataagtagaataactgaaatttcctaatcacattataccctataagtggtaaaaataatagcatgaatactagcataagagtttttaggctcccccaacccagattattttctgttgttaatagtcaaatatcacaaatgtgttcgaaggcttcttgtgcaccttcccttgtttagaggtaatgactattctgaacttggtgcgtatcctgtcatctttttatactttatcatatatattttccattgtattgtgtttttaaattttatgtcaatagtacatcatactctatgtatctttctacaacctttttttaacctaatattttcagtaaatttatctgtgttgatcagattcatctaactgctaatgtggtattgtataacattatttattcattcttctgtggatggatgtacatttagattttgtccaattttttgctttatcaaatgaagtttgatacatctttgttgatttctttttgtggccatgtactcacgtgcaaggctttctcttagggtataagaaatcatagggtatttggtttttcatcatacttaccagatgtggccagattgctttccagagcatgtatttatactgtcaccagcattgtatgagagttcccatttcttcatatccttgccagctcttggttttgtcagactttaaaaattttagcaatctgggtgtgaaatggtgggggtgagggaggaaggatgcatgtattttaaattttcttcaaacaaaaaagtcagagaaatgcttagtgaatttatattgatgccacatcactccttgattagtttcatctgtttcttttgcctctttgggcctatcttttgaaatgctttgttggtattttaatgaaaaatctgataggttacatgcattttgacatcagtgttgtccttatagttcttaaggacttccttcagttttcagattgtttgttcccaaccctgatttgttgaatagatccatatctgccaaagatatcatgcttttttttaagctgtgattttttttagggggtgggggtcagtaatagaaaatgtcatatgtacaaaattcaatttgcttcatgtggaagttgaatgttcacccttctggtcacttgcatcactgtcttggtaagttaataaggtaactatagcaaacagtagattctccagacatctctggagctcactcagctatcagtgtaccacactgcctcagaggtgggacattaacttctaagtgtgtgcattttaaacataattatcccttacaaattaagttttgatccattaagtgttcttgtgaagtgcaagaatttttggattacgtgtctctctcagtttaacggatgatgtctctctcagtttaacggatgaaccataaaaatcgatttctttttcttttttgacatggagtctcactctgttacccaggctggagtgcagtggcgcagctcggctcactgcaacctctgcctcctgggttcaagcgattctcttgcctcagcctcccaagtagctgggattacaggtgcccaccaccatgtccagctaattttgttatttttagtagagatgaggtttcaccgtgtcagccaggctggttttcagctcttgacctcaagtgttccgtccacctcagcctcccgaactgctggaattaaaggcatgagccactatgtctagctaaaaatgtatttctaaataatgtttttcctatagtgcctatgatattatagtttattttctttattttctttatttttttgagacaggatctcactctgctatcaacccaggctggagtgcagtggcacaatcacagctcactacagcctcaacctcccaagctaaggtgatcctcctacctcagtctcccaagtagccaggactacaggcatgtgccaccacaagcagctaatttttgtattttttgtagagacagggttttgccatgttatccaggctggtttcgaactcctgagctcaagcaatccacccccccgcaccccgcagcctcccaaagtggtggggttacaggcaagagccactgtacctggcctgatattatagtttctattgtgacaataaattaaaagactctttagtgttagtttactttcaatttggtttattatattcaatttggtatgttcatgtcagtcatccatgcctcttcctttgaaccaaaggaatttacaacttattcttgtttctcatcaaactcggtttgctttttatatgaagctttttacagtctttttctgcccataccactttccttatttcattttcttctttgttttcttgcctactttttcttctcatgttctctactttggaaacagccttccttttcaaatgctgcattacttttgatttattttaaaatcagattcccaggcagtctgcctttaatattgttaatagatcagtaagtaagacaagcagaaatactttaccaaagcagaatagctaaaaatcttctactatctctgccatgcatgttcaaataatgttgccagaatatcaagtcatgtaaaaaaaattattggtgctatctgcgtggattaatggcatactgtcatcttatgtgttttgcatgtccctaagagaaacatttataattgctgcattatgagctcatcttctcagtttactagttctcgtaaccgaaaaaataatagcattgtcaaaatttaatatgcatctttagtttctggaactaactcatgttaaactattaagaagttagtttcttagcatctgctgttgttggactatgtccatccaaaatttaggtggtgaaacttcatggccagtgtgatggtattaagaggtggggcctacaggaatgggatttaaggcccttatgaaagaggctttatgcagccactagctctcttgcccttcagccttcaccatgtgaggacatagcattcttcccctctggaggatgcagcaacaaggtgccatcttggaagtggagagcagccctcactagacaattgaacccgctggtgctttgaatcttggactacccagcctctagaactgtgagaaaataaatttgtttttttataaattatccagtccttggtattttgttatgggagcataaatgcactaagatagtatcctttcctagagtggaaggcgggatagagaattatttaagggaaaaacatcaaaacgtgggtcttcatcttcattttaggagtatactgataatcagttactgcctgtaagtgactaatggggccagaaaaaaaaagtgaatggagatgattgtatgatttgaatatttgattatattgggtcatgtgatcctccagtgcatacacctccaagcttggactctgtttgatactggaattcaacagctcattgtcagaccagggcatgcttttctgtagtctgcaaatgtctgatcactagcaaaacgtgcccataactttacttccttttgatttatttctcataaatgccttttctgttagcatctttttaaaaacatatgtgaccaccattggataggttatagctaagtccggttctgggcattttagtgactctttgaagtgtattcaatcaaaatttattaaagaaaccactgttgtgtttgtttctctaccagttttctttgtgatgttatcggacacttaataaatatatacagttttatgtgttttatcagagaaaatgtaggctagtctgtctttgaccagtagtttctggtcaaatacaatattatactagtataatattgacttagtctcagaactgtatattctgagagaaatgttgttggagaagtcatattttcttgtgtaggcttgttgttgttttttcacatacctgtcattttttttttatagtgtcagaaagggaactatgtgattttctgtgtaacagcataaaaagagccctgtaggacatgactttctcctttttccattatttataaaatttcttttattatggaaaatatcaaatgtcacacatacacaaaaataaaggtaataacataatgaacctatgccatcaccaagctccagacgttttaaacattttgtcattcttggtttatctactccttccaccctttctttctgtcatttttgttggagtattttaagagcaaatcctagacatcatgtcattttatccataaataattcaacatgcatatctaactgatcaggtctttattaaaatttatttttttgaggcaagatttcactctatcagccaggctggagtgcattggcatgatcatagctcactgcagccttgaacttttggactcaagccatcctgctgccttagcctcctgaacagctgggactataggtgcgtgccaccacacctggctgatttttaaattttttgcagagatgtgctattgctgtgttgcccagtctggtcttgaattcctggcctcaagtaggtctttgtaatttatttttaatttttttttagagacagggtctcactttattgctcaggctagagtgcagtggtaccattatagctcactgcagccttgaactcttgggctcaagtgttcctcctgccttagcctcccaagtagctgggactataggtataagtcacctgcgcccagctggtctttttaaaaaagtaacataaccacttactatctccctgcttaacaaatcgacagtatttccttaatataatttaatacccagtcaatattatttctctggtgatctcaaagttgttgttttacagttgtatttttttaaattatgtctgttaagtcccttttattcccttttccttttttttctttctctttatgacattggttagctggggaaacctagtcatatgttatgtggaatgttccacattctggagttgactactttggtggttaacatgttcctttaatgcctatgtttcctacacactggttagagcttgtggcttgattagattcgagttaaattttaaaattaactccataggtggcgctatgaactttcttttgaactgcgtgaaccaacacctaatgtcctgtcccactttttatgatgctgattgatgagtgaggttcaggtgatgagagcctgatccctccatataaagttctccttaagttttatctactggttttggcagcctttgatgatcattgcctagaaccactatttcattaggggttacaaaatgatgatttttttcattccattattccttttacttttattaactggaattctataaacaggaacatccttcatgaaccatttggttaccctgaactatatataggaaaggcagggtaagtctataattagtcttctttatcagttttcagagtaatgagttggtgtcctaaccatttttagtagtgatctgtaattttcatgacatatcatgaatatggatattattattttttttttgtatttcagcctattcagtattactttgatctcagattatcccattttaggccagtggggagcatctttagataggcttgtttttttgaattgactgtgttattattctttgatagagaggaaacttccttgctttctggcacagttttttttccaggtttctattccagagtaggaactaggcatttcttcaatgagccttggcccttctttttccccccttaagagataggttcttgccatgttgctcaggctggagtgcagtggctattcacagatgcgatcatggtgcactacagcctggaactcctgggctcaagtgatcttcctgcttcagccttctgagtagctgggactacaggttttccactccttgcctggcaaggcttgattgctttgaacagggatgacatttaagcagcagagtctagctaggttctaggggtgattattgctatatagtttgtcataaacagagacaggaaatatgtaagttcatattgttcaaattgaaaaccacagggtttatatttatatctcttttcttctgaaaatttggttcctaaggatattaacatgattattcttttattcatactattaactcatactattttattcatactattaataacattaagactactgaatacaggtttttttgtactttatatccttaaaatatatcactctagatatgatcagtcaaaatcttgttttaaagacatctgaggtaattcatttctctttgtggctatgcccttaacatgttatacagttgagttcatttatttcatttcctcagatttttagggattgtcctcgttttttcttttgattcattgttttcatttgtttgttttagaaacaatatcttgttctgttgcccggcctggagtgcagtggcatgatcatagctcagtgcagccttgaactcctgggctcaagggatcctcctgtcacagcctcccaaatagttaggcctacaggcatgcaagtaccaccatacctggctatttttttttattttttattttatttatttttattttattattatttttttcagatggagtcttgctctgtcgcccaggctggagtgcagtggcgtgatctcagctcactgcaagctctgcctcccgggttcacgccattctcctgtctcagcctcctgagtagctggcactataggcgcccgccaccatgcccggctaattttttgtatttttagtagagatggggtttcaccatgttagccaggttggtctcgatctcctgacctcatgatccacctgccttggcctcccaaagtgctgggattacaggcgtgagccactgcgcccagcctttttttttttttttttttttttttttttttttttttaaatatattgtctcattattttgcccggggttgtcttgaactccctggctcaggagatcttcctgccttggcctcccgaagtgtcaggattacaggctctagccgccatgcccagccaatttattgtttttaattatgtaaaacttttaaattctttgacagtccaaactagactaataaggtacattaatagaagtctcactttcattcttatacttttcaacctattcccttcctttttctatgtgaccattttgttagttttactatttccagttttttaaaatacaagcaaatatatatctactcctatattctctcaacataaacacaaaagatagcgtactggctgggcgtggtggctcacacctgtaatcccagcactctgagaggccaaggtgggtggatcacctgaggtcaggagtttgagaccagcctggccaatatggtgaaacaccatccctactaaaaatacaaaaattagctgagcgtggtggtgggcacctgtaatcccagctactcaggagggtgaggcacgagaatttcttgaacccggcggggcacggaggttgcagtgagccatcgcaccactgcatttttagcctgggcaacagagtgagacttcgtctcaaaaaaaaaaaaaaaaaaaagcatactataaatactgttatgtactttggtgctttaatttattgatataccccagtcattacttcatgtatagaaatcctcatttctttttatagctacgtgttattactctattttgtggaggttctacagttttttttacttattgtcagtagaggatgatttattgggaaacttagagatggaagcatggtcttgggcagtagcaagacaggtagatctctgcaccgttagtccccagacccatgacttaagtgtcatagggaaaggatgtacatgctctgtagggacaaaggcaagctccagaacaggcaagaatgctatgcgtgtcatagcctgtaatttttgtgataacatcaaggttgctttgctctaaaggcaggatttatagtgggtacatgttcctacactaaggacagcaagtaaagtagaaatcagcaggcattcgtgggactgaggttaatcaaaagtgaacatggtagattagcatgcaagatggagtcactgttgtcttcacacccatcagtttctacttttttcatcccatttcttaataaccatctaaagattgccaccctgctagagcgcgtcccatgaccatcccctttcttttttcccttagtttcacccctatcaatgttgtctttattcacctttttttttttttttttttttttttttttctggacggagtcttgctctgtcacccagactggagtgcagtggtgcaatcttggcccactgcaacctcgcttcccgggttcaagcgattctcgtgcctcagcctccccagtagttggaattacaggcgtgtgctaccatgcccggctaattttttgtatttttagtaaagacggcctttcgccatgttgcccaggctggtctcgatctcctgagctcaagtagtccgtctgcctcccaaagtgctcaaattaccggtgtgagccactgtgcccagcccttttctttaatttagactggcatttatgtataccattttcatttttcatcattctttattgtacctcagactttccttttggaattttcctccttgaaacacattgttaagaagccctcaaatgtgctttgtttggcttggaattctttgtttcctgaatctgaacttccatgcattttaattttggaaatttttctaccattatctctttaaatactatcttatctatattctttctgttctcttcttctagaattccaagtagacagactttagtttttttgtctttgtgtgtgttttgtttttgtttttgttttttttaagagatggagtctcgctccgtcgcccaggctggagtgcagtagcgccatcttggcttactgtaagctctacctcccaggttcatgccattctcctgcctcagcttcccaagtagctgggactacaagcacccaccaccacgcccggctaattttttgtatttttagtagagacggggtttcaccatgttagccaggatgatcgcgatctcctgacctcatgatctgcctgcttcggcctcccaaagtgctgggattacaggcgtgagccaccgcgcccggccttgtctttgtgttttaactagcatttcatgtttttatctctctctactgcattctgggtagtttatgccatgataatttattcagctctctctgctggatttattattttctttttagttgtgtttaatctattttttttttttttttcgagacagcgtcttgctctgtcactcaggctggagtgcagtggcgtgatcttggctcactgcaagctctgtctcctgggttcacaccattctcctgccacagcctcctgagtagctgggactacaggcatccgccaccacgcccggcgaagtttttgtatttttagtagagacaggctttcaccgtgttagccaggatggtctcaatctcctgacctcatgatccgcctgcctcagcctcccaaactgctgggattacaggcgtgagccacgcactcggccttaatctacattttaaccagcctaatgagttttgaactgtcgttggttatctttatgatttttggaaggtcttttgtttttcccattccaatatgcctgctctttgttggggtattttttatttttatttattaatttatttattttttgatggagtttcattgttgttgcccaggctggaccgcaatggcgtgatcttggctcactgctacctctgcctctcaggttcaagtgattctcctgcctcagcctcctgagtagctgggattacaggcacccgccaccatgcctggctgatttttatatttttagtagagacagggtttcaccatgttggccaggctggtctcgaatttccgacctcaggtgatccgcctgcctcggcctcccaaagtgctgggattgcaggcgtgagccaccacgcctggcctaggatatcttatttgttcatattttctatttttaaatttattataattttctctatagcattgaaattatctttcttaatgaaaaatgctattccattaaattgatatatctgcctatatattccttatttcctcgcttttagcttattacagtttttagctataatatgtttcagccacaaaaatcttttatacaggaaggtccccaacccctagtactaaatctcaatgaaataactgaaaaatagtagtattaagtcatagagtttaaattcttcttttctcttattgctgaatttcttaaaagcaaagttaccagtttacattgctgcttcctcccactattaggttttgccatttaatgttataacatcaggagcacaaacttctggaggtgtatggaacagattccatttcttacttttaaacatgtgaccttggacatattagttaacctctattttagttcctcatctgtaataagatggctttgaggattaaataagtgacaaatacttggcagatagtaagacctcaataaatctaggccattattttaaaatatttttatttgtggtggttttaatttcttcagtgatgaatgagactaagtattttctgaagtgttttctatttatattttatctcatgtgaactatcaaatacctccttttcttaaaatagaagtttcactgcagaagcgagttgacataataacaccaaaagcacaagtgctgaaagattaataagttggacttcatcacagtttcaaaagtgcaccatcaagagagtgaaaagacaacacacagaatgggaaaaatattttaaaatcatgtagccgagccaggcacctgcagtggctcacacctgtaatcccagcagtttgggaggctgaagtgggtggatcacgtgaggtcaggagttcaagaccagcctggccaacatggtgaaaccccgtcttgactaaaaatacaaaaattagccagcatggtagcacacgcctgtaatcccagctacgtgggaggctgaggcaggagaatcgcttgaacctgggagatggagattgcagtgagctgagatcgtgtcactgcactctagcctgggtgacagagtgagactctgtctcaataaagaactctaacagagtgcaagcagtggtgcagtcatagctcactgtaaccttgaactcttgggcttaagcattcttcttgccttagcctctcagctagccaggactacaggtatgcaccacaatgtctggctaatttctaaaaattttttttttgttagatatgagggtctcattacgttgtccaggttcgtctcaaactcctggccttaagcagttctccttccttggcctcccaaacactggattacaggtgtgaaaccaccgtgcctagccaccaaattttttaaatgggcaaaagctttgaaaaggtattttttccaaagaagatacacaaatggaaataagcacacgataataggcccaacataactagtcaccagggaaatgcaaatcaaaaccacaatgaaatgcctcttcatactcaccagaatgtctacaataaaaaaggacaataacaagcattagcaaggatgtggagaaattggaatttcataccttgttggtgggaatgtaaaatgatgtagccactttggaaaacagtttggcagttcctcaaaacgttaagcgtagagttgctataggaccagtcagttccattcatatgtatatactcaagaaatgaaaacatgttcacatagaaacttacacacaaatgttcacagtagcattatgtccagaataggcaaatttgtagagacagaaagtagattagtggttgtctagggctggggcaaggtggggaagttaatgggtagtgactgttaatggttacagggtttctttttggagtgatgaaaatgttctaaaattagattgtggtgatggttgctctactctgtaaatatactaagaactactgtaatctttcaatgagtgaatttatggtatttaaatgacatattaatgctgtttaaaagaaagaatccagttgacgtatttacctctcctcctgtacattcatctcttgcccagattgttggttagggatgagatagatatatctcatatggtggccgggcgcggtggcttatgcctgtaatcccagcaccttgggaggccaaggcgggtggatcacctgagatcaggagttcgagaccagcctgatcaactccatctctactaaaaatacaaaattagctgggcatggtggcacatgcctataatcccagctactcaggaggctgagacaggagaatcacttgaacctgggaggcggaggttgtggtgagctgagattgtgccattgcattccagcctgggcaacagagcaagactctgtctcaaaagaaaaaaaaaaaaagagatgtatctcatatggtaattcctactgttaggaaatagtatatttcaacttaatggatgtttcattttggtatgatggctgataatttcagtcttgggttctctaggttctgtgtcccctaataccagctgtgtgattcttgtttatctacattatattatagattgttccattgtttataaaattagggtaatttttgctcatccagaggattattgtgaacttcaaatagaagtgagacagcattttgaaagctgtgtagtcctaaataaatacacagtagtgttaagattcctaaagttctctgtattttcttttcataggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactaggtatgttatctgggcctaatttaaggttatagttatattgagggatatatattctctatttttctgtctttccctcatttatatatggtattttcttactttttagaagtcaggagctttacttgttaaatatacattattctcttctttattctcaaagtaaatgatggctgatttttctcacctaatagtgctataacagtggttgtgtttctttgctctatattctccaggaatttcaaaattgaagctaacgtaactaagtcaaaaatgtttgtttaccatgttgccattttaatcagtttcctttgaagggtgttatgttttattgcatttcatattttaaaataaagtgatttaaaatagatgggctgaaaatatatttatcatattcaaatgttggaaaaatacaccttaggagaattttatcagtagtactttgaacagagatgtagtgtttcttcaagtatggcccaagcaccacgtgcatcagaattacttggatacttgttagaaatgaaaatttcttgatctctaccctagatctgctaaattgtaatctctggagatggagtccagaatttgtatgataataagtttaggtggcctttggtatataacgaagctttaaaactttaaaaattatttttacaaaataggaaaatatgtgcatgttagaatcaaacagctcaaaaggattgatctgctgaaaatgaactttggataattgggttatttcttagttgggtaataataaatcaagatattggttcaagtaatcttttttcctttcagtattttccagtggtatttcctcttgacttaaaatatactttgtactcattatagaaaatttattaaaacagagaaagatacagaagagtcatctataagccagtcactcaaagacacctacacatttgtttccttttagtgtatacgcctcttccctgcacacacttttcctttgcttttacaaaattaggttaatattggatatcgtaacatttattgtgagcagtttctgaaggacaagaaatattttacaatctaagcctaggtatcctaaacacttagttactgtcacaagtgaagtctctatatattcttctgcctttttatttttatgtgtgtgtggttctttagttttttttttttttcctctcagatgggtagcgtagtcatcttttcttctactaaaaggtagttcaaaattatgactagcaattctgaggcagttagtggattccagcttattcgaaaattatatctttagtttcccttttccttcttacttagaaatttgggactgaacttcactcagcccttagaagtaggctacatttataatgtatctgtggtaaaggttgcttttgaattgcttatcccctgtcttcctcatgtgattgtttttctgtcttggaaaaatctttttcatttcttaaaataagtaggatgagtaagattttaaacttcatttgacatcaaattgaacttagttcctttagctgattagtaaattctcaaagtaaaagcaccagttgccacctttaaataaatagctgtttctgtctccagaactgtcttttttgagacagggtttcactccttttgcccaggctggagtgcaatggcatgatctcggctcactgcaacccccgcctcccgggttcaagtgattctcctgcctcagcctcctgagtagctgggattgcaagcacccaccaccacgcccagctaattttgtatttttagtagagacgaggtttcactatgttggtcaggctggtctcgaactcctgacctgaggtgatccacccacctcagtctcccaaaatgctgggattacaggtgtgagccaccaggcctggcccagaactgtttttatataggtgactatatgtcctgatttacttgggggcagtagtaacttatacctattattttggtataataatttttattagtgcctcctttcactcacaacagcaacctggtttggaagataaattataatgtctcctatttttatattactatattctgatgcttgaacaagcatgaacttacccatggacatgctttgtttctcttctaatagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatggtaaagtggaaaagccaattgtgtgtatgtgaatgtgtgtgtgtatgtgtttgtacacagttctggagagaatcagttattttatatttaagcctatgtgataaaaatcagaatgactgcataaaatattacagtatgtcagcttaggcaacatagaccccattacaaaaaaatttaaaaattagctgggcatgctggtgtacacttgtagtcttagctactcaggagtctgaggtgggaggatcacttgaaccaggagttcaggggcacagtgagttatgattacaccactgcactccagcctgggctacagaataagaccctgtctctaaaaaacttttttttttttttttgagatggagtctcaccctgccacccaggctagagtgcagtggcatgatctcggctcactgcaaattccgcctcttgggttcaagcgattcacctgcctcagcctcctgagtagctgggattacaggtgcccgccaccatacccggctaatttttgtatttttagtagagatggggtttcaccatgttggccaggctggtctcaaactcctgaccttgtgatccacctgccttggtctcccaaagtggtgggattacaggcgtgagctgctgtgcccagcctaaaaaactttaaaaaaaaaattacagtataccattctctctctgtgggtgccacatttaatatgttccaattattagtaaaatagctttaaaataaagcttgtgaatcatatactattacatatgtttggggcaatattacctttttcatttgatccttccagggtgaaggatcaaataagtttaaaggaagtgatagttttttttatatttaatgcaagagagatttcagcagtatttttttttttttttttgagacagaaacccaccctatcacccaggctggaatgcggtagcgcagtctcggctcactgcaacctccgcctcctgggttcaagcaattcttgtgcttcagcctcccaagtagctgggactacaggcattcgccaccatgcccggctaacttttttgtatttttagtaaagacggggtttccttatgttggccaggctggtctcaaactcctgacctcaggtgatcctcccgcctcggcctcctaaagtgctgggattacaggcgtcagccaccacactcatctgttcagcagccttaattagagacaataacactactctgtgcatcttatgagatacaacagattcatctatacaataatcccttgtagttttgctcctagttaatcttcacaagattgcttagtgaaatgctttagtctgtttaatactgaaaatgcagaaagttttcaacagattttgtctttaatatttctttaaaatatatctataaatattactttgtttattgtatatgtatttataactcagaattccagttctatagatgttaatagatactaggccaaaagcaaaaagaacaaagtctggggaacatttgttaaacaaagttgaacataggtttttgtttagcctcaaaacttctcagaacctttttatgataatgtgcattgtgatatgatatacattctttctcaatattaattgattatggaaccttttgaaaaggaatttcatgtggtattagttttcagttgaacacaggcttgcatagaaggagttagtgaatttttggagtaagtacttttaggtgtaaacatttgaaaagtgtttaacattttctttactactggtaaactcaagctgggctttgcatttcgatattgatgactgttgacagcttaaccactaacagcaaagtatacaatacgtatggtgacactttcaatagataggttcatggagtcctaggaggacatgcttgagctaatgagtaaatacaaagatggtgacactgttagactcattattttcttttttttttctctgagacggagtctcgctctgttgctcaggctagagtgcagtggcgccatttcggcccctgggttcacgccattctcctgcctcagcctcctgagtagctgggactacgggcgcctgccaccacgcccagctaattttttgtatttttagtagagatggggtttcaccttgttagccaggatggtcttgatctcctgacctcgtgatccgcctgcctcggcctcccaaagtgctgggattacaggcgtgagccactgcacctgttccctcattaaacattttcttttctgtttcattactaaatattttagtatgtatcttttaaagatacaaattcaaaataactacaataccattatcacctaaaaattcacaagttttgtaatatcaaatatctagtgttcaaatttccgcagtaagcagaaatttttattgctcttaataactcttaaggaacaaaataaaactgtagatataaaacaaagagtctgctaatttcccggtttgttaatgtaacacatactcaactttgcctaagatcaaaagaacattcttgccaggcacgatggctcatgcctgtaatctcagcactttgggaggccaaggtgggtggatcacctgaggtcaggagttcaagaccagcctggccaacatggtgaaaccccatctctactaaaaatacaaaaagttagccgagcatggtggcaggggcctgtaatctcagctacttgggaggctgaggcaggagaattgcttgaacccaggaggcagaggctgcagtgagccgagatcaaggcattgcagtgcagcctgggtaacagagcaagactttgtctaaacaaaaacaaaaacaaaaaattctttttctcagaatagctacattcatctcatcattatataaaagacttactaaaaattaaagccttggatttgactctaggtaaagtgcatggagaataaacatgaatcattatttgttttagtatactattagtataataattgaaacagactactcatattcctgcttatgtgacatacttgtttttgttttgttttgtttttttgagacagcttcttgctctgtcacccaggctggagtgtagtggcatgatcatggctcactgcaacctctacctcctgggcttaagcagtcctcccatttcagcccctcaagtatgtgggactacaggcaagtgccctcatgtccggctaattttttaaattttttgtagagacgagatttcgctgtgtgacctaggctgatcttggtctccttgggctcaagtgatcctcctacctcagcatcccaaagtgctggggttataggcatgagccaccatgccaggcctgacatacttgtttaattaagagaagtaggcaacaaaataacttattaatataatacatagatgattgaagggaatttgttttgttgactgctctatttttatactgcctaataaaagcatctgggatctttgtttaataacttattttttctttttcagagctatccattttttattttgcccttaaaaaaattcctttttttttttttttttttttgccacaagcatttaactgtgaggtatttaggaaaacctagttttttttttcttctagaaactttttgtctctgggtgctttccagttactttgtgccatttagagcaatgccaggcattcatttaatattttcataaacatggcttttttttcatatttaaacatttgaactttattttgatgagtgaagggttaaaagagatacactacctttctccttatttaagacctcgcctctctcacccagaaaataatcattaatactgtatttaaaattctgaacatcctgtttgaggcaaaatatttgcagagtactgcttcttttgtatgtttttccagagatactctgtatatgcaagcatgattattgtctcttatctgcataggaatagatattaaaagtattattactgtaatatattcatcatattcttaactttatgtttagacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaagggtaaataatgttttctttctttctcctcaatttactgtacctttgtatcaatttttctttgtaaaaaaataggataattgatatacgaataatgccacagattttttaaagatattttgcctcagcataatggagttactaatgatgctgtgtttatgccagtttttccatttgttatcaacacaagtaatgtacccttaactgggttttaagcactgaattatgaaaattattgtgagatttttattcaccattaacaaatttgtgtttcactgtcttcctgataaacttttctctgtattttggagtcttttaatctcagaggctactcaaagcccagctttttcacttctgtatttttactgaaagaataccgtggaagtatttttattcccttttaggcacattgttactattataaaaagatataattgggcacaagtattatgttaatttgaaatggtgatagttttctgactttaacccacagaatttatcttaaaaagaaaaagaatctaacgtaaacccaatctataagcttagtgttgagcataaaaactctttagtgagaatgtggaaaagactaccctttatgctcttgccttttcccccatcagcttgttcttaaaacatatttggtcttcttgatagtaaaatacaagctgccatcactttcataaagagattgttgaataaattctaggcatgctttgctgtcttacacaggagttggcagattttttccataaaggtcaatattagatattttttaggctttggaggccatatgatctctgtcatgactatttagttctgccattatagtgcaaaagcagccaaagaaaatatgtaaatgaaagagtgtggctatattacagtaaaattttatttccagtggcaggtagcaggctgaatttggtctgtggccatagtttgttgacccttattatatcaaaggtttgaattatctggatatctatactacaaaatgaagttagaatttcttttagagtttttctgcttctccaaattggtggttttttttttttttggccaaagattacattataaatgcaaaagactggtctaacattaatatatattattggtgccatccaaggtaattaattcatttcaacttggagatcaagttatattctggagattcctcaatttggattgtttttgatcaataaatttaatggcaataaaatttcatgctctcacaacctcagaatcatcgttccattaaaaaaaattgaaattattatctaggcggtcacctctttcttgctgtttttaacatttatgagctcttttcctctgcctttgttctcagtccaagattatttcactgtatatgttaatgagagtggctatcttgaagggacaaaagattgaccttaaaatgaattttaaacattaacctgtgcaaacagttccatcactaaaaaaaattaaagtcaaaggttttggaatggatcattaattgcaaataggcattcttctttttttccccttctctccccacccccagatggctattttaactgtaaattagacttcaaattttagatatgtctctttttcttactgtcatgtcctttcaccattgaaagaaatttaatttccaatctcttttgtttgtatgtcctccatctatgcaaaacaaaaaattgaagaaaaaaaaaaaaccccaaaaacctaaaaaactaactggctttcaaggctcagcacaaggtgactggaagtgtatggagttattttctctttttagcctcctttgtaaaaaccctggaattctgactggttgggtaaatgtgattcagttttttgttttgtaatgcaactattttgatggttggcttcacagctgaggcgagccaccatttcaaacccaataacaggagacttggagacggtacattacagaattagcaaaaggtaagagatgtgtatgctgcatattttgccctctaatgagtgttttatacatcttacaggaattattcatttaaggaaagtgggtcattttcagtcaccagctcaagtcaccaccctgtatataaacaggataacgcatggataaactgctttgtgtttcacaggtctttctccttcactagaagttctgtttttaacctttaattggtatgttatttttagggaattaatatgctttttatctttcttcagatcaggtgtcaaatatccaggaagtggcctgatacttgttttctttttcccttttgttgccaaagggggaaataaagcagcagcctcctgaatctgggagtagtagtcttcacctatgcagttttctcatattcataaatgctgcggtgattcatatcctccttcatggtgattacgttggcatttgttcatacatcttgtaaaataacattgtcattatgtagtaatctgtattcctcctgtttgagttttttatttaaaaaaattcgctgactcaaaagttggcagtaggaagaacagagttacgcttctgagctctgtcttccaaaaattagttgtaaacttagttgccttttactttgccagagagatttaaaaacagttttatctcagtgagaggtttgaaaaatgaatttaaggagtctactattttttttcaaaatatttaaataacttctagatctgagaaagtttctgtgaaacccagtgctataaatcatttacatacagcttcaaatgattttttgtttaaaaaaagtgaaaggacaataaatctacaacaaaaatctgtcaactcattttctcttgatttggaagtggctgttcttactgccacttttctaaatgtttttgtggattcgagaccattacccaccatccagaccaatctgaacccttccaatcacctgtggcttggcaaaacaaaacaaacaaaaagcccaaaattgcctgctactggagtaagtccttgtcctttctctttttttgtagctgagccgagctacagtacatgaccctgagactggaaaattgaccacagcacagtacagagtatctaagaggtaagggagtaatggagagaactttagtcatatttggaccatttctttcttgggaatctaattttctgaaaactcatgatatagtttctaagacctaggtggttaggcatagatgtttgataatatctgtgctggagttttcatgacggactaataaacatggttatggggcagttaataggggttttccaaagtaacattaacttacataatgtctgttgaggctccccaaactttgataagtgaaatgtgttctcatattgaactaagagaagttcccaaattcccttcattaaacaaggcctcttttggactctgcagtaaagcaggggtttaaaaatctcagggtcacctagtagctgcaggtattgcgtaagtaagtgcctttataacaaagcctttgcaagttccttgcttttaacagtgtttaaagataatcttattaggttattagttgattgatcactaaaatgttttttaaaaagagctcactgtgtaacttagagctcacagaattgggtgacagtattacaatagaactccttttccatctacttgtgaaggtttctcggctctcatgaaaatagaaatatctttgtgctgaatttttattctaacaagtagaatatttatccacagacacaataactaatgaaatataacaaacataagccccatccatctcattaggaacatcttaatacattttcacttgtttatacttgataatgattgtttagtcatgttatttagattaacaaatgtgaataataattatagtaacaatccagaagatactatctttaacacagcctttttataggtctttaacacaggctttttgttttaggaaattcatatttttgttaattgtataaatatttttaatatagataagtataatgtgataaataaaagattttcaggcataaaaatgtgtcactgtaggacaaggtttcttaaccttatcaatagcactattgacattttgagtcagataattcttgttcttgggggctatcttcagctttgtaggatgtttaatagcatctgtggttcactggatgccagtagcacccttccttaagttgtgacaatcaaaaatgtctccagacattgtcaaatgtcccctgataggtaaaatccccaccactacctctagtgactccacccctgttgagaattaactgttctaggataagaatggaatgaaactataacatcaagaaaaaaaaaaaagatgtaaaatgtccaagtattaaaaaatattttgttcacatattttaagtggatgatggtggatatcaaatcattatggtatttagattccagtggatacatttaaagtaatcattttttagaaattaccaacgttttcaatatgacaattcaatcattcgaaactaaattatgaaaaaatttagttgtcaactaaaaaatttatgcaaaggcaaacatagattttaacaggcattttaggaggtactcagagaaattttgaagattactgctgtcttcaaaaagaaaaagattaggctggaccgaatgtgttgattcagcatttcctttttcttttttgggcaggaccatatgccttttatatattaaccttaaacgttactatacacgtcttggtttcttgtctctgctgtataacaccacctgcccttttgccccagtaagagagaaaaattttttttcttgcctatcactagcttcatagctgagacccctataacaaaagacagattaacaagagaaaatcatacaaatttatttaatacaaaatttacttgacaagaagcctttagaaatgaagaccgcagcctgagcaacatgttaaaaccccaactctacaaaaaatacaaaaaaaattagccaggtgtggtggcatgtacctgtagacccagttacttgggaggctgaggtgggaggatcacctgagcctgaggaggttgaggctacagagagccacagtgagccatgagcatgccactgcactccagccagggtgacagagtaagatcctgtctcaaaaaaaaaaagagaaaagaaatagaaaaaaatgagaacccaaagaaacagggaaacctgtgtatttttatgctaggtttgatgagtggatagtcatacagaagtatgatgaacaaaggggatatgatctaatggtaataaactgggggaaacttagcaaagcctgtttgttcacatacctcttggtatctctgtgtctcaggataaggatgttcatttcttccaggtagagagaggatacttctggattgaaagtcttatactactttagaggaaggtcagagaattctttttttttttttttgggggggggatggagtcttgctctgtcgcccccaggctggagtgcagtggcgcaatcttggctcactgcaagctccgcctcctgggttcatgccattcttctgcctcagcctcctgagtacctgggactacaggcgcccgctgctgcccggctaattttttgtatttttagtagagatgggtttcaccgtgttagccaggatggtctcgatctcctgacctcgtgacccgcctgcctcggcctcccaaagtgctgggattacaagcatgagcccgtgcctggcctagacaattcttttatagcctgcttaaggggaaaagagtgggagaaggtcagagagacctgcttctgctcaaatgctacagtgccatattttggggttgagtgtcctgaaccccattagaagacatgaagaaaatttaaatttgccataatatgattttcattttaatcacaggagcaattatccttaaggaacactaatagatagtaaggatttgcagaaactaatttgcatagacatgttttgagatatgatttacagtgcttctgaacattgcaattaacccgatttttacattaagctaattttccattctattacagaacctaattcatatctacaaaaaaccccttctttaaaaaaaataaaaattaaactgttaacagattttatcagattattgcatggttttacacattttttgtcataaagtttgtaaatagctaaatcctctagatttgcatgcttctaggaagcatataaaacaaaattacggccaggagtggtggctcacgcctgtaatcccagcactttgggaggccaaggtgggtggatcacaaggtcaggagatcaagaccatcctcacaaacatggtaaaaccccatctctactaaaaatacaaaaattagctgggtgtggtggcgcgcctgtaatcccagctactcgggaggctgaggcaggagaatggcttgaacccgggaggtagagattgcagtgagccgagatcatgccactgcactccagcctggcgacagagagagatccatctcaaaaaaaaaaaaaaaaaaattcatgaattcgatgttttggaagactgtttgtttttggaaattttctatgtatgcaatgacccttttgaagaaatatccagcccacagtcaatggactgttgccaataaatcaaaataaatcactgtaggaaagtgatctatacacttaaaaaaaaaaactaaatattgctaaacatttcaaacctattttttaaatattctaactttgtagctcttaagcagttttattggatttttgagaaaggtacaaccatacttacatattataaatgatagcagaaggtatttagctactagcattagaaggccgggcatggtggctcatgcctgtaatatcagcactttgggaggctgaggtgagaggatggtttgagcccaggagcttgagaccagcctggatagtatagctagaccttgtctctatttacaaaaaattaagaaaaaaattagctgagagtgatggtgcacgtctgtagtcccagctacccaggaggcttaggtgggtagatcacttgagcctgggaagcagagattgcagtgagctgagattgcaccactgcactccaggctgggtgacagagcaaaaactctgtctcaaaaaaaaaaaaaaaaaaaaaaaaggccatctcagttgccaaatggaagaaaattcgtgttctgatgtcagttaatttaatcccttgtagcctgggaacatctgtattttgaatgatttagaaaggaatttcaaatatctgtatttagagaactgtctaagcgatgacatcactttcagtggaagtaataatttgttccagcatttcagcaaatagaatttttttggcaaaatatttttggaactcctttagtatttaaaaaacataaaacaggcggggcatggtggctcacgcctgtaatcctagcactttgggaggcccaggcgggcagatcccgaggtcaggagatcgagaccgttctggctaacacagtgaaaccccatctctactaaaaatacaaaaaaattagccgggcatggtggcgggtgcctgtggtcccaactactggggaggctgaggcaggagaacggcaggaacccaggaggcagagcttgcagtgagctgaaattgcgccactgcactccagcctgggcaacagagcgagactcaaaaaacaaacaaacccataaaacaaaaaaggcttttttttttttaagaggcagggtcttgctctgtcatctaggcctaagtccagtggcatgatcatagctcactgctccttccaactcctgggcagaagtgatcttcctacctcagtctcccgagtagctgggaatacaggtgctcaccaccatgcttggataatttttaattttttattttgtagagacagggtttcactatattgcctaggctggtctcaaactcccgggctcaagtgatcctcccagagtattggtattacaggcgcgagccattgcatccagccaaaaaaggctttacttatgttactgacaatctgttaacttttggcaagtcatctctgtcttttccactattaaaaagcaaataaaggccgggcacggtggctcacgcctgtaatcccagcactttgggaggccgaggcgggcggatcacgaggtcaggagatcgagaccatcccggctaaaacggtgaaacctcgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaataaaaaccctaagaatttactacagcttgtaaatgaaaaagctaataattttgggtagatcagagaaatggaatttgaagtttttgaaatgtaaacattcagttttgtgctctgaaaagatagttaagtgaactcataaagtctagttaaagtaatataaataatgacctatgcaaataaacaataatctgtttagagtggtagaaaagcttttttgattctggtgggaaagtgattttcatttttttactctgaagtgatgatttcctacaatacggtatttatgatatcatgaatgtaacatgatatatatgtatatgtgtgtatttatttatttattttattttactttattttctttcggagacagggtctcactctgtcgcccaggctggagtgcagtggcacagtcatggctcactacagcctccacctcccaggctcaagcaatcctcccacctcagcctcctgagtaactggggctacgggtgcacaccaccatgcccagctaagttttgtatttttgtagagatgcggttttgctttgttgcccaggctggtcttgaactcctgggctcaagtgatcatctcaccttggcctcccaaagtgctgggattacaggcatgagccaccatgtctggccttaaatatatcataaatatgttatttaggcttaagattttgtttacccttgttactaaggagcaaattagtattaaagtataatatatataaacaaatacaaaaagttttgagtggttcagcttttttattttttttaatggcataacttttaacaacactgctctgtaatgggttgaactgtggtactcagactgagataactgaaatgagtggatgtatagtgttattgcataattatcccactatgaagcaaagggactggataaattcccagtctagattattagcctttgttaaccatcaagcacctagagaagaattattggaaattttgtcctctgtaactggcactttggggtgtgacttatcttttgcctttgtaaaaaaaaaaaaaaaaaaatatatatatatatatatatatatatatatatatatatatatatatagtggttttcgattagctaatcatagaatattcttatgtgtgtgtcgggttagaagaaggtagtgatcatgttcaaattacattactgacatttttctttggagctttccttactcacatattagaagtgtagttttgcagtgtgagaatgttgctcccttactctgcgcattctagtggtattttacaaaatcatgaagttttttttttttttttttaacagcggaaactcagtagaaaggaaaaaagcatagaaatgttactctaattgaatgcacagctttggcttcaggtcctgtcattaaggccaaaaggaacatactttgggctatttaatttttaatggaaaaaaaaggacacatataaagttatctgaagaaatagttcttttttctcctggcactaaattgtgttttatggggaaaaacactgtataattagttgacattttcaattacagttatacaaaagataaatgatcttcaaatgatttttcctattaaatgctataacattaaaaaaaaatcccaactcagttaaagcactgggtactagaaagcaaaacctctggatttcttatgatttaatctaacacaggaataagacttccaggtcctagaagaatggacagttaacatacattacagtataatggtctccactgaattttagtaatgttacaatgtaaattcagagctgagtttttagataacctattatgtctataataatgtcactgaagacagattagcagtaattgttaaggatgggatccagatgagtaacttgaagatagttcttaaactaaggaaagtcttaatgtattttgggccaggtgtgacggctcacacctgtaattccagcactttgggaggtcaaggcaggtagattgcttgagctcaggagtttgagaccagcctgggcaacatggtgaaacctcatctctacaaaaaaatacaaaaattagccgggcgtggtggtgcatgcttgtagttccagttactccggaggctgaggtgggaggattgcttgagcccgggaggtagaagttgcagtgagtcgagatagcgtcattgcactctagcctgggtgacagaaccagactccatctcaaaaaaaaagggagtgttactatattttggaggggattttacatgaaagtcaaattaaatgaaataacttcccatgcatcagtagaattcattttcctctgtagtgactacaacagaactacaattaagatgacagtttgacagttattttttttttaacctacaatcaacattggttttaactgctaagcctcaaacccttcatcaagatttttttttttttttttgagacggagttttgctcttgttgcccagactcgagtgcaatggcgtgatctcggctcactgcaacctctgcctcctggttcaagagattcttctgcctcagcctcccaagtagctgaagttacaggtgtgcaccttcacacctggctaattttgtatttttagtggaggcggggtttcaccacgttggtcaggctggtctcgaactcctgacctcaagagatccacccgcctcagtctcccaaagtgctgggattacaggcgtgagccactgcgcctggccgagatatgttatgatataacaagaaatgcaaataaaaacttaaaaaatttaaaccattaaaatatttttgccttgctaagattgacaaagaataaaaggattgaaactggcaagggttttatgaaatgggtaggtgtaaatcattgcaactgttttggagggaaatttgacatttatcaaaatgtaaaagtcatttagcaattccacatctaggaatttatcgtacagagatactcccacaagtgtgcaaagatatagcattttgttacaatattgtttataacagagaaaaattagaaataacctattatttaaccagtacttaattggtagactttcatggccattcctggaattaaaagtttgtggtggtgttctgttgtttttttaagagatgaggtctcattctgttgccaaggctggagtgtagtggtgtgggcatagcaacctcgaactcctgggctcaagcaatcctcctgcctcagcctctaagtagctgaaactataaacctgtgccaccacaccttgctcattaatttattttaattttttttgtaaagacggggtcttgctatgtttcccagactggtcttcaactcctatccccaaacgatcctcccaccttggcttcccaaagtgctgggaggttattagattttttttttttttctaaaagcagtagtttaaaaggcagtgagggatgggaatataaagtggtgtcactgctgtggaatatagtctgccagctcctcaaaaagtttagggttaccatgtgatctagcaattctacttctaggtacatacccaaaataatttaaagcaaggagtcatatacttgcacacctatgttcataacagcatttattcactatagcccaaggttagaagcaacccaaatgtccatcaacaaatgaatggataaacatgtggtatatatagataatagaatattattcagccttaaaaaaggaaatgaatttctgataccctgcttataacatggatgaaccttgaaaacattattttggctgggtgtggtggctcacacctgtaatctcagcactttgggaggctgaggcaggcagattgcctgagtccaggagtttgacaccagcctggtcaccatgatgaaaccccgtctctactaaaaatacaaaaaactatggtggtgcatgcctgtagtcccagctacttgggaggctgaggtggaagagtcacctgagcccggaaggttgaggctgcagtgagccaagattgcatcactgcactccagcctgggcaactggagttgagaccctgtctccaaaaaaaaaaaaaaaaaccacacacacatgttaagtgaaataagctagaattgacaaatattatatgattcttcttacaggagatacctagaataggcaaatccatacagacagaacgtagaatagaggattaccaggggttgtgaggagggagagatgggagttgttgttcagtgggtacagttttctgtttggttttgatgaaaaagttctggaaatggatagtgctgatggttgtaaggtattgtaaatgtacttaacaccagtgaattgtacacttaattaaaatggtaaaattgctgttatatatattttaccataatttaaaaaatagtctaaatggctaattttatgttacatgtattttaccacaaatttttatttttttagagataggttctcattctggggcccaggctggagtgcagtggtgtgattgtagctccctgcatccttgaactcctgggcttaagtaatccttccgcttcagccttatgagtagctaggactacacaggcacacgctaccatgcctggctaatttttaaactttttttgtggagacagggtcttgctaggttgccgagactggtcttgaactcaagtgattttcctgccttggcttcccaaagtgctgggattacagatttgagacactgtgcccatcctgtttaactttcctgatgttattctttgaagcataaaaggtttttatttggataatgtcccatttatttattccttttgttgcctgtacttttgatgtcatagctaaaccattgcttcgtccaacgtcacaaagatttgctcctgtgttttcttcccacagtttttataattttagcttttacatttaggtctttgatccatcttgagtaattcgttttaatataatgtgaagcagaggtccagcttctttctttgcatgtagataaccagtgtcccatgaccatttgtggaatgtaacaagcatttcttacttttgcagttttaaaggagtaaagtgaaagactggagtggtaatttgctagaatggctaaagtgaaggtatttttcttggtagcaggagacttcaataagcaagcattgacaaggaggagattaaagataaaagggaggcaataactgctggagtaaggcatctagagttagaaagcatagaatcaaaagcatagatagaaagtctgcctctataaggctgaaggacgatgattctaccaaagtacaagaggaaaagataagactagatatttaaaagttgttggtagcagggagggaagttgaagatatcagaagacacgttctctgtgggtgataggttccaggatggaataggaacagtttgttcatgaggcatttagttcgaagctttattagaatgctttccaatttagcattgcaattacctgtaaaaatcaagtcagtagttggttggttgcttataaagttcagacatccatcaaattgtgctaggcaggaaagacaggtacattgacatataccagattagttctaccaggaacttgggcagaattagaagaaaaaaattcttaatatacttaatcagctatattctttacaacaataacactttgattcttcccatttttgctacactgaggaattctgtaatactcagccagtcccaaaaaatttgcaagatatcaccaagcaaataattttagtaatataggataaatctaagaatccaccctgtttgtcatgttagtttcatgttggtaatgattagtaaaaacttctttcttctccatgtctttctcttgttaaagaaaaacccacacactctctcttgctctctctcttacgcttgctcgcttcctttgtctgtctgtggaagctttggcttcgtctggcagcgggagaggtaaaggaaagcttctctaaagaagtggtaactaaggtgatatccagagtcttaattttgcaaagtgaaaaagaatattctgggcagagagaagagcatacgcactagccttaggcctagaggaaatacgttcttgaggaaatgttgctgctgtcctgagagggaggcagaatatagtgttggaggctgtaaattaggagaccaagaaaaagcagcctgagatactagaggaattcctggagaatgagtgtttgagagagtttccaaaaggatgagtattgtcacaaatgttaccaaaggaacaaatacaatgagaattgaaaaatgtcattagatttagaagcacaatagggctgtgggtaagattagcaagagcaattttgagggagtgatataagtgactaaagctagattacagtgggttcagagattaggaatctgacaaagttagcttgaagagggaaaagaaagattggtaactggagggatgtacagatttggggaaatcatttttaattgtaaaggcgtttatttgctctatgaagtaggaaatacattatctactgagtgaagggagaggctgaagtgagttagggtacagagtggaagaggaagtaaagtgaagagcccatttgaagttggtattcatgaatttttagtggaacatatctgccctatttcatgactttctccagtagggtttggtgacagagatatacgcttagataaaagagattgatccaggattgtttttgccagacagttgagtttaggcgtttagaaagaatgttaaaatgatgaactatggaatcaaagctcagtgagaggagaagtgaagaaagcgaaggactgattgactgcttaaaagcatatgtgaaaaagggatatagctgaatttgggagtaccatttaaaattgagatatagttcccgtatcataaaattcacgcttttaaagtatgcatttcagtggtttttagccttgtgcaactataaccaatgtctagttccagaacatttttgtcactcaaaaaaaatcctgtacccattaggagtcatttcccattccccccagccccatccccatcccctggcaaccactaatctattttctattatctattgatttgtctattctgtatatttcatagaagtggcattatataacatgtggcctttgtatctggcttctttgacttaatatgatgttccatccatgttgtagcatgtatgtagagacagggtctcactctgtcacccaggttggagtgcagtggtgtgatcataattcactgcagcctcaaactcccatgctcaagcggctctcttgcttcagctgccagagtagctggaattacaggtgcatgccaccatgcccagctaattttttaaatgttttgtagagttggggtctcactgtattgcccaggctggtctcaaactcctggcctcaagagacctttccacctcagcctcccaaagtgctgggattacaggcatgagccactgtgcctggccagtactttattcctttttgtgacacaataatattccagtttatagatctatcacgttttatgtatccattgataaattgatggatatttgggtagtttctactttttggctattatatgtaatgatgccataaaaaattctgtacaagttattgtatggacataagatttaatttctcttggatatatacctagaagtaaattgctgggtcatttgataactgtgtttagcattttgagcaactaccaaactgttttccaaagtggctgccccttttacattcccattagcaatgtatgagggctccagtttcttcacatccttaccaacacctgttattgtccatccttcagtaggtgtgtttgggtaacttttcaaaacttaagcagtaagcagaatttttttcttataaaatattagcattatgtagctcagactaaagaccccatgacttccaccatagtcagttcctataccttacctggaaagaacgttgttttgtttggtatggttttttaaagaattttttgaagttctcaatgtaggtggctttcaatatagcctccttacattaatccaactgttttcatataagcattataataaatttgattagttttttccttcccaacctctaacagtagaatgtgacatttaaaaaaaattacaatatccattaataaagatgatactaagcaagaaaatgaactaaatgccttcagtaaaggtttattgtcctatatattaaatattatggctttaaaaataacagctattagtctccatgtaatgaaacattatcaataaaactaatattcctcttattcttagtgcctggctctctggctatgaaaatcctgtggtgtctcgaattaatatgagaatacaagatctaacaggactagatgtttccacagcagaggaattacaggtaggtaatcacattatccttaagtcatttttacacttcaggagatgcttgagaggagatttcctgacactgaacaggcagtcctcaatttgcatgatagtttgggaccttaaaaagtgaccctgtaagctgcaaccatgcaaagtgattttaataatgggaaaaattgtgattgttctgtgacttttaaatttcttgtcaaaacatgaaaactcttatctagggaaatgaaaaatatagatcactaatacttactaagtacactgtaattttttttctatcccccaggcctcactttgcctgtcaagtggccagggtgggttttaaaaaatagtgggtttttttcctttttatttatttatttttaagcaaacagttttcctttatttgtaatagtgaaacataggacttttttcatcacttctctttttctgttacttttatgtctataaatcatttgtcatcaaaagtagctgtcccaaaataattcttcttcactccgtcataatcacaacttgactcaaaatatctgtagtaaacaggtatatataggaatgttagttatagggaataaacataaaatccatgtataataatctcacttggtttcaatagtaaaaaaaaaaaactaagcataggcctataaaccagagaaaagaaacagcttagtcttcccctttgtcagcgttatttactattccttagtcttttcctgtagaaaaatactttttaaaatatttgagttcccttttctgtattagattttttttttgaagttatcaaaatgtgcactaaaaaaaccaatgcctttattttagcctttctggttgcaattttttttttttttttttttttgagatggagtctgagtctggctctgtggcccaagctggagtgcagtgacatgatctcgactcactacaacccctgtctcctggttcaagcgattctcctgcctcagcctcccaagtagctgggattacaggcatgcgccaccacactgagctaattttgtatttttagtagagacggggtttcaccatgttggccaggctgctcttgaactcctgacctcaagtgatccacctgccttggcctcccaaagtgctgggattacacaggcgtgaggcactgtgcctggcctggttgcaaaattctaagacagatgcagtcaatatgcagctcataaattcattagaaaggtgatacttttgcttcttttcaacctttctttttctttttgagacagtctcactggagtgcagtggtgcaatcttggatcagtgcgacctctgcttcctgggctcaagtgattctcctgcctcagcctcccaggtagctgggaccacaggcacatgccgccacggctagctaatttttgtatttttagtagagatggggtttcaccatgttggccaggctggtcttgaactcctggcctcaagtgatctgcctgccttggcctcccaaagtgttgggattacaggcatgagccactgtgtctggcctcttttcaactttaaataataaactgttgtccgggtctggtggctcatgcctgtaatcccagcattttgggaggccgagccaggtggatcacctgaagtcaggagttcgagaccagcctgaccaacatggagaaaccccgtctctactaaaaaatacaaaaaaattagctgggcgtggtggcacatgactgtaattccagctactcggcaggctgaggtaggagaattgcttgaacccaggaggtggaggttgcggtgagctgagattgcgccattgcactccagcctgggcaacgagagcaaaactctgtttcagaaataaataaataaataaactgttaatttatcagaagaccaaaatgtattcttaaagacagttaattccctttttctaattaagttttaaaaatgtattttgtgtgtgtgtgtgtgtgtgtgtgtgtgtgtgtgtgtgttttacagtgacacggtttgatgccatcctactccgtctttgtcagaacacgtggtcttttcttctgtttttttttcctatctcaaaattatgaaagcttttatttataacgcttgcagttttttaaaagtgagattcataaaactgtgttcacccaacacactgaatcctatcatgacttggcatgaaaaacagcaacccactcagagtccagtaacactgtgccctcccctgtgatgcacacctgccaggtttattcagtgtttgactgttgttcagtattcatccaacaacatttttgatacatgtggtgctaaatgttgggaatgcaaacctgaataaggtatcgtcctgattcctgcctaatggttttcctgggtttcactggctatgatttctgattcttccctccctccctctgtccctccctccctccctctctccctccctcccctcctctctccctcccttccttcctctctctctcccttccttccttccatatttccttccttccatgtttgcttgcttccttccttccttccttcccttccctccctccctgcatccatccttccctcctttcctttctttcttctctctcttcctccctcccaccctctttatttctttacttccttccttcctctctccctcccccctccccctccctgactcccttctttccttccttccttccctttttttttttttatactttaagttctagggtacatgtgcacaacgtgcaggtttgttacataggtatacatgtgccatgttggtttgctgcacccatcaactcatcatttacattaggtatttctcctaatgctattcctcccccagccccccaccctccgacaggccccggtgtgtgatgttccctgccctgtgtccaagtgttctcattgttcaatttccacctatgagtgagaacatgtggtgtttggttttctgtccttgtgagagtttgctgagaatgatggtttccagcttcatccatgtccctgcaaaggacatgaactcatccttttttatggctgcatggtattccatggtgtacatgtgccacattttcttaatccagtctattattgatggacatttgggttggttccaagtctttgctattgtgaatagtgccacagtaaacatacgtgtatatgtgtctttatagtagcatgatttataatcctttgggtatttacccagtaatgggattgctgggtcaaatggtatttctacttctggatccttgagaaatcaccacactgtcttccacaatggctgaactaatttacactcccaccaacagtgtaaaagcattcctatttctccacatcctctccagcatctgttgtttcctcactttttaatgattgccattctaactggcatgagatggtatctcattgtggttttgcttcgcatttctcttatgaccagtgatgatgagcattttttcatgtgcctgttggctgcataaatgtcttcttttgagaagtgtctgttcatatcctttgcccactttttgatggggttgtttttttcttgtaaatttaagttctttgtagatctggatatcagccatttgtcagatgggtagattgcaaaaattttctcccattctgtaggttgcctgttcactctgatggtagtttcttttgccatgcagaagctctttagtttaattagatcccacttgtatattttggcttttgtagccattgcttttggtgttttagtcatgaagtccttgcccatgcctatgtcctgaatggtattgcctaggttttcttctagggtttttatggttttaggtctaacatttaagtctttaatccatcttgaattaattgttatataaagtgtaaggaagggatccagtttcagctttctacatatggctagccagttttcccagcaccgtttattaaatagggaatcctttccccatttcttgtttttgtcaggttcgtcaaagatcagatggttgtagatgtgtgttgttatttctgaggcctctgttctgttctattggtctatgtctctgttttggtaccagtactatgctattttggttactgtagccttgtagtatagtttgaagtcaggtagcatgatgcctccagctttgttcttttggcttaggattgtcttggctatgtgggctcttttttggttccatatgaactttaaagtagatttttccaattctgtgaagaaagtcattggtagcttgatggggatggcattgaatctgtaaattaccttgggcagtatggccattttcacgatattgattcttcctatccatgagcatggaatgttcttccatttgtgtcctcttttatttcgttgagcagtggtttgtagttctccttgaagaggttcttcacatcccttgtaagttggattcctaggtattttattctctttgtagcaattgtgaatgggagttcactcatgatttggctctctgtctgttattggtatataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctgttttcctaattgaataccctttatttctttctcttgccttattgccctggccagaacttccaacactatgttgaataggagtggtgagggagggtatccttgtcttgtgccggatttcaaacagtgcttccagtttttgcccattcagtatgatattggctgtgggtttgtcataaatagctcttattattttgagatatgttccatcaatacctagtttaccgcattttcagcatgaagggctgttgaattttgtcaaaggccttttctgcatctattgagataatcatgtggtttttgtcattggttctgtttatgtgatggattacgtttattgatttgtgtatgttgaaccagccttgcatcccagggatgaagctgacttgattgtggtggataagctttttgatgtgctgctggattcggttggatttttgcgtcgatgttcatcagcgatattggcctaaaattctctttttttgttgtgtctctgccaggctttggtatcaggatgatactggcctcataaaatgagttagggaggattccctctttttctgttgattggaatagtttcagaaggaatggtaccagctcctcttagtacctctgatagaattcggctgtgaatccatctggtcctgaactttttttagttggtaggctgttattgcctcaatttcagagtctgttatttttctattcagagattcaacttcttcctggtttggtcttgggtgtatgtgtccaggaatttatccatttcttctagattttctagtttatttgcatagaggtgtttatagtattctctgatggtagtttgtatttctgtgggatctgtggtgatatcccctttatcattttttactgtgtctatttgattattctctcttttcttctttattagtcttgctagctgtctatcaattttgttgatcttttcaaaaaaccagctcctggattcattgattttttgaagggttttttatgtctgtatctctttcagttctgctttgatctgagttatttcttgccttctgctagcttttgaatttgtttgctcttgcttctcttgttcttttaattgtgatgttagggtgtcgattttaggtctttcttgctttctcttgtgggcatttagtgctataaattttcctctacactgctttaaatgtgtcccagagattctggtacgttgtgtctttgttctcattggtttcaaagaacatgtttatttctgccttcatttcgttatttacccagtagtcattcaggagcaggttgttcagtttccatgtagttgtgtggttttgagtgagtttcttaatcctgagttctaatttgattgcactgtggtctgagagacagtttgttgtgatttctgttcttttacatttgctgaggagtgctttacttccaattatgtggtcagttttagaataagtgtgatgtggtgctgagaagaatgtatattctgttgatttggggtggacagagttctgtagatgtctattataatggtctgcttagtgcagagctgagttccagtcctggatattcttgttaaccttctgtcttgttgatctcatattgacagtggagtgttaaagtctctcattattattgtgtgagagtctaagtctctttttaggactctaaggacttgccttatgaatctgggtgcccctgtattgggtgcatatatatttagaatagttagcacttcttgttgaattgatccctataccattacgtaatggccttctttgtctcttttgatctgtgttggtttaaagtctgtttgatcagagactaggattgcagccgctgcttttttttttttttttctttccatttgcttcgtagatcttcctccatccctttattttgagcctatgtgtgtctctgcacatgagatgtgtctcctgatgggtcttgactctttatccaatttgccagtctgtgccttttcattgggacatttagcccatttacatttaaggctaatattgttatatgtgaatttgatcctgtcattatgatgttcgctggttattttgctcgttaattgatgcggtttcttcatagcatcgatggtctttataatttggcatgtttttgcagtggctggtaccagttgttcctttccatgtttagtgcttccttcaggagctcttgtaagacaggcctggtggtgacaaaatctctcagcatttgcttgtctgcaaaggattttatttctcctttatttagaaagcttagtttggctggatatgaaattctgggttgaaaattcttttttttaagaatgttgaatattggcccccactctcttcttgcttgtagggtttctgcagagagatccactgttagtctgatgggcctccctttgtgggtaacccgacctttctctctggctgcccttaagattttttccttcatttcagccttggtgaatctgacaattacgtgtcttgtggttgctcttctcgagaagtatctttgtggtgttctctgtatttctgaatttgactgttggcctgccttgctaggttggggaaattctcctggataatttcctgaatagtgtttttcagcctgtttccattctccccgtcactttcaggtgtacaccaatcaaacatagatttggtctttttagatagtcccatatttcttggaggctttatttgtttctttctactcatttttctctaaacttgtcttcttgctttatttcattaattccatcttcaatcactgataccctttgttccacttgatcaaatcggctaccgaagcttgtgcatgcaccatgacgttcttatgccatggttttcagctccatcaggtcattcaaggtcttctctacactgtttgttctagttagccattcgtctaaccttttttcaagggttttagcttccttgcgatggcttagaacatgcttctttagctgggaggtttgttattaccgaccttctgaagcctacttctgtcagctcatcaaagtcattctctgtccagctttgttctgttgcttgtgaggagctgcagtcctttggaggagaggaggtgctctgatctttagaagtttcagcttttctgctctggtttctccccatctttgtggttttgtctacctttggccttcgatgttggtgacctacagatggggttttggtgtagatgacctttttgttgatgttgatgctattcctttctgttagttttccttctaacagtcaggtccctcagctgcaggtctgttggagtttgctggaggtccattccagacgctgtttgcctgggtatcaccagcagaggatgcagaacagcaaatattgctgcctgatccttcctctggaagcttcatcccagaggggcacccgcctgtatgaggtgtctgtcggcccctactgggaggtttcccccagttaggctacacgggggtcagggaccctcttgaggaggcagtctttggttctcagagctcaaatgccatcctgggagaaccactgctctcttcagagctgtcagacagggacgtttaagtctgcagaagttgtctgctggcttttgttcagctatgccctgcccacagaggtggagtctacagaggcagtaggccttgctgagctgtggtgggctccgcccagtttgagctttctggccattttgtttacctaatcaagcctcagcaatggtggacacccctcctccagccaggctgcaacctctcaggtccatctcagactgctgcactagcagtgagcaaggctccatgggcatgggacccactgagccaggcacaggaaagaatctcctggtctgccagttgctaagactgtgggaaaagcgcagtatgtgggcaggattgtccggtttttccaggtacagtctgtcatggcttccctttgctaggaaagggaaattccctgactccttgtgcttcctgggtgaggcgatgccccgccctgctttggctcattctctatggtctgcacccactgtccaaccagtcccaatgagatgaaccaggtacctcagttggaaatgcagaaatcccacatgtgagtgagaacatgtgatatttgtctatgctgggcttattttactaatataatgaactccagttccatccatgtgataagattacattcttcttatggctgaatagtgtttcattatatataagcaccacattttctttatccattcatctgttgatggacacttaggttgattccatatgttagctgttgtgaatagtcctgcaataaacatgggaatgcggatatctcttcatcatgctaatttcctttcttttggatatatacttggcactgggattgctggatcatatggtagatctatttttagtttttaagggaacctctgtactgttctccatagtgattgtactaatttacattcccaccagcagtgtatgagcatgcccctttctcttcatccttgccagtgtctgttatttttgggtttttttgtttgttttttcttgagatgtagtcttactctcttgcccaggctggagtgcagtggtgtgatcttggctcactgcaacctccacctcctgggttaatgcagttctcctgcctcagcctcctgtgtaactgggattacaggcccctgccaccatgcccagctaatttttatatttttagtagagacagggttttaccatgttggccaggctggtctcgtactcctgacctcaggtgatccatccactttggcctcccaaagtgctggaattacaggtgtgagccactgtgcctggccaggatgctgaatttttttgaaagctttttctgcatttgcagagatgatcatatggtttttaattctgtttatgtggtgaattacatttattgaaccaaccttgcaccccacaaataaagcctaattgattatagtaaattaactttttgatgtgctgctaggttttgttttctagtatttttttgagtattttgtgtctgtgttcatcaggaatatcagcctgaagttttcttttttcattatgtctgtgatgagttttggtatcagaatgatgatgctggcttcataaaatgagttaaggaaagattcgttctcaatcttttggaataatttcagtaggattgatactagctctttgtatgtctggtaaaattcagctgtgaatccatccagtccagagctttttttggttagtaggttgtttttttgtttttttgtttttaattaaaattgaatttcaatttcagaattccttattggtctgttcagggtttcagtttttttctgtttcagtcttgggaggttgtgtgtttccaggaatttatccatttcttctaggttttttataaaagtttgtgtgcatagaggtgttcataataatctctgaggactttttatatttctttggggtcagttgtaatgtcacctttgttatttctgattgtgcttatttggatcttttttctttgttaatctagctatcttgctgtttctagaattctttatttgtctttgatgtttgacaatctgactgaaatgtgcttcagaggggactttttttggttgaatctatttggggacttttgaacttcctggagttggatacccttatctcttccccagacttgggtagttttcagctattattaaataggttttctgtgccttttacctttcttctccttttggaactcctgtaatacaaatgtttaatggtgtcccagaagtcttgtaggctctctttatcctttttcattattgtttcctttttttttcccctctgagtaatattaaataatgtatcttcaggttcagagattgttttgcttaatcaagtgtgctggtgcagctttgtattgtatttttaatttcattcattgaattctttttttttttttttttctgagacagagtctcgctctgtcgccacgctggagtgcagtggcaagatcttggctcactgcaacctccgcctcccaggttcaagcgattctcctgcctcagcctcctgcattcattgaattcttcagctgcaagtgttttgtttggttcttttttatgatatctttctttgttgaaattctgattcatatcatgaattgttttcctgatttcattgaattatctatctgtattttcttttatctgtttgagtttccttaagatcattatttgaatttttttctagctaggtgttgatttcctttacatttgggcctgtaactagagagttacattctcagcagtgtcatatttcattgctttttaatgtttcttgtttcctgcattgatgtctgtgcatctagtggaacaattggctcttttaaactttccgcttctgttgggctgtttgggaagggtgtggtgactctgtttccaggtaggttcagtactgtagtctcttatagcctattcagctgcattcattgtcagaataactgtgggtgcctcaacagcctaggctggagaagtttgcagtggtggtagctgtggagtagattgttaatatcttcagtggcaagagcttttggaatccttccattcttgttttccccacaatagggagttttagccagtgggagtcttcttggtggcaggtcttacatatcctacaagcagctgccatggtgctgcaatccaggtgcaagcgtttggagtggctatggggctaggatcctgggctcagggtcttgcatactattgtaacacctgggtgttagggtacagggtcactattggcagggttggatgtaggttgcctatagtgccaggatctgtgactctgaggcaccctctagctgcttgggaaaagagtgtcaggttgtagctgtgagtctacccctggtggacagggcacagccctggcccaactccagggaagagaggatgctctggaggtttgagtctgggatgcagggtttggctctattaggagcctgagccaatagggcttagtggcaactcctatccctggggatgaggcaccatgatgaggtgccctggatgaggcaccaggttctagtagtcactctagaacctggattggtggagctcagatggatcccagactctgaggccaggtacagcaggaacaggcacccctgaatggccaagcatgcctgttgtttgggccctgtggggcagagagcagcacagcaatgacttcactccctagaaagagaagtgtctcagcagcgcagactctccagggaagcagggtactagagttatttgccctgcagggcacatttctcagcttagccactgctctgtttccctgggtctctgggtactacttcagccctgggatgtgcagctgctcagcttggccagtgcaacaattccccaagggtgatgtgctgtttcagctcaggctcaggggacgtgactgttctgggtggcccagacatctcatgggatgcagggttctgccaaagtactattttcttgggagggagtacatggctgcagctcctgcctcagggagttgggggaggggtgggtagagcagttccacctctcttgaccccaccaggaagggtgtaacagctgctggcagctctgcttgggaatgtcaggccttcaagtaggccttcattcctggcttagcttcagggatgaaggggtgctgtggctactggccccagagcaagacacactccagcagttccagttccaccagtattctccttctggtttcatcagcagcactcttaattatgttctcctttgattttgtcagcattttattgtgttgtgtgattgagggaaagagttaagtatcattctcttcactttaacaaataagaaaactgagatgatatccaaagttacattgtaattaagagagctggaacttgaactcagaccaaatatttttcttaaattttggtgcgtcacactgggacattgtcgtaagcaactgaagttgttagggcccttcgacaggaataattaaattggtgttaatttctttccttttttagcagggaaaaaatatgtaagaaaagatattttattaaagtggattgcgagttcagcatttggggctttggaaaacattttttgatttaagttccaaaggaaagtgtttagtgaaacaaaataatagaaatctcaaattttagcttatgtattaaatttttaaaaattagctgggtgtggtagcatgcacctgtagtcccagctactcaggaggctgaagtgggaggatcacttgtgccccaaaggttgaggctgcagtgtgctctgattgcatcactgcactccagcctgtctctggtggggggtggggaggggtacatatgtagatatagatctatatatatagatatctatatatgtagatctgtatagagatatagatatctatatatacatctgtagatatagatatctatatatacatctgtagatatagatatctatatatacatctgtagatatagatatctatatatacatctgtagatatagatatctatatatacatctgtagatatagatatctatatatacatctgtagatatagatctgtacatagatatatagtagctgtcctttgtttttcatccctgttttcataggaactcttgttgattttaaatatttttcatttctctgtaaatacctgaccatgatctataaaagtccaaaaaatgaggttcatagattttttttgaatagtaatctttatagttcttttctttcatgctttgtgtctttccttcaggtagcaaattatggagttggaggacagtatgaaccccattttgactttgcacgggtaagtgaaaaagaaatggagaaattcactgaggcttatgcattacattgtttgtctcaaaacaaaacaaaaaaacagtctcactctgtcacccaggctggagtgcagtagcacgatcttggctcactgcaacctctgcctcctgggttggagcaattctcctacctcagcctcccgagtagctgggatcacaggcatgcgccaccatgcccagctaatttttgtatttttagtagcgacagggtttcgccattttggccaggctggtcttgaacttctgacctcaggtgatccacccacctcagcctcccagagtgctgggattacaggcgtgagccactgtgcccggccgcattacattgttaaagaaaaagttattcttgacacttgttaaagatggtaaggcagacttcattcaaggggggaccattgcgataggtatagggaccactgcaaatgcagtgggattttgcagtaagggagagaggttaagcccaattccaaatacaacaaggaaaagtgggaatttatagccaatgagcaagggtgggtgttagtagatggaaaattactaagaggtaagggaagattctggctaaactgacctaacaggattcttgctgaagtcagggaagagtgatcatcatccaggggatagtggaagatgaagaacccagttaggttttgagggtgatcacatggcaaggacggggaattctggctaacctgacttagcagggttcttgcttaaattggacaatgcagaggtaaataccagaagcccaaagtcagggcctacttgagaagaaagttcagaggagcctgagtagttgggtcaaggagagattctttgtcaacatgttaattctgttattttaacattaaaaattcatagcctatttggaatttatggaaatacggtgtggcagatattctgtgaaacctttttaccagttaaaaaaaaaaaaccaaacacctagatacccaataaaatcacttaagatactttaaatgcattggcaagcctggaagaaagtaaagggtgttccaaaaggcaaactgaacaatgatcccaaacttagagaattaaagaggggacaaaacacagaggctggaggtatgtgcctccaggaactagagctttgggaataacagctctgtaagaggaggatctgccacagtgtaggctgctgaatttgagaccctggcataaactctaaatctccacaaggattacaccttcagtaaagaaagaatgggtttgaaaataaatctcttgtgatacaggagccttatggggaactgtctgtttccatcctggctggggcatagtgtgtatgataggggagctacttcagggagtactatgtatggaattttccacttgtgtcatgttagcactaaaagttttgaacttcagagcattttgcattttggacttttggtatgctcaacctgtattccatgttacggatataccacagtttagccattcacccatcgaaggacatttggatagtttttagtttttggctattacaaataaagatgtgtttacatttctatgtgaaaaatgcattttcatttttctgggagaaatgccaagaggttgtattgtattttaatttagatataaatatttagatattaattctttagcttgattatagtgctgaaagtcactttactagcattattagaaaaataatactaggggccaggcgtggtggctcatgcctgtaatcccagcactttgggaggccaaggtgggtggatcacttgaggtcaggagttcaagaccagtctggccaacatggtgaaactccatctctactaaaaatacaaaaaaattagccaggcatggtggtacacgcctgtagccccagccacttgggaggctgaggcagaagaattgcttaaacccgggaggtggaggttgcaatgagctgagatcatggcactgcactccagcctgggcgacagggcaagactctgtctcaaaaaaaaaaaaaaagaaaaaagaaaataatactaggaaatatttcagtaggtcgtgagttcaaagtaagtctcaaggtaaattaagcttcaggagtatagctaagagatggctgtcaagtcatattttttagaagctaaaattgtgggtatttgtttttaaaataatatgtagcttgcagataatggctgtcgtttaggctaataagtctgctttttatccagtaatcttgtctaaagtatccagtatacaagttcagtcatcacgtatttgaggccaggtacagtggctcacacctgtgatcctagcattttgggaggctaaggcaggaggatcgcttgaggccaggagttcaagatcaccctggtccacatagcaagactccatcttacaaaaagattgcctgatgtttatagtgcactggacattacaagggaaacttttgcggttgttgttggcatattcttcaggatattactactgatgtttagttgccactagagtatttgtattactgaatttttacaccattgaatttactgtgtttttattcacagaaagatgagccagatgctttcaaagagctggggacaggaaatagaattgctacatggctgttttatgtaagtcgtcactaaaatttttagattaagttgggatttgatgacaagattcattttaatgttttaagtttgttctgtgtagctctgattcagcatcctagtttaacatttttacaactgaataaagtgagttaagaattattttgcacttgcaactttttcaggctataagatagatgttcattatagaaacttctggacaaacttagaatttatagtgccactacctgcagataatcattaatattttaacatatagtctctctgtttagtaatatataatatgtgtatataaaaatctctatatatttgaatttctatacatacacatacacattatttcagtaaacttctgaattacatttttttattgaagtatatcagaagagtgcgcaaattaagtattataacttaattttcacaaagtgaacacttctggtgtattcagtactaagatgaagaaatagcatattacaacccccagaaaccctatctcagagttttaaaacagtatgatcataattcaatttttaaaattgtttatatatttttatatatggaaaaaagttttgattgtagtgtttgttctagttaccccaaataaagcactccaaaactctcctttctgagtggtttaaaataacaacgattttcttaatgtatctctaacagttatgaggttgactgggctcaactcatggttcctgctccaaatctgacatgtatttgccgtcaaatgcctggcactggggtatcttgaaggctaaggttgaggctggctgtcagccagaatgcctaaagtctggccaatacatgtggctgagcttcttcacagcatagtgactggattgcaagaggaagcatcccaaaagaacaatgcaaaagtacatggtattgttatgacctaccctcagaagtcacagatgttaattttgctgtattctgttacagcaattacaaaggtctgcccagcttcaaggagagggcacacagaccctaccactgcagacgaatgtcagcgtcacataaaaagagcatgtaggatgggacatattgggatgtattatatttggaaaatgcaatctgccataatgtcataacctttgttaacttaaaaaagatattttaggccaggcacagtgacacacgcctgtaatcccaacactttgagaggccgaggcgggcagatcacttgaggtcaggagttcgagaccagcctggccaacgtggtgaaaccccttctccactataaatacaaaaattagctgggtgtggtggcacacacctgtagtaccagctactcaggaggctgaggcacgagaatcacttgaacctgggaggcagaggttgcagtgagccgagatcgcgccactgcactctccagcctggataacggagcgtggctccatctcaaaaaataaaaataaaaaaaatatatatattttatatgtagacttaattttggttatttcatcactttttccattccttagccctatttgaattacatctttttgttgtctgtagtatctcactccctaccaaaatctgtctgttcagtctatttcctttttctcttcctgctaccttccctgtttgttttctttcccttcttccctatctccttcctctccgtatgcctccttttctccccaattcccaatttgtatttctctcacaactccatcttgtttccaaaaggaggtaaggtacattacaaagattcatataaaaaaagagaaataccacaaagggaaaaccaggagagggttagtacggtatacaaattcatgctgcaaaggcttgcatattttctagaggtgagtcttagaggttgtaccagtttatatcccaattttaagtgggatatgtttgtgaagtatgtttgtcagactttttgatctatgtatatttcacttattaaattagcagttattgtggctttaatttgcatttctcttattagagaggttgagcatcttttcagatgtttaaaagccattagtgtttatgtgttcctggttctgcttatatttctttgttttatgaatattgatgctgtattatttggcccactatctgtttctccctcttaatgtaaacacccttcctgtttttctaaaatagttgtatagcattttaattgattatcattttttccgttatttaaataccattcccagaggggcacatagaatatctcaaattacttttcctctcatgcacaactttttaatttcctcagagtttaattttttcattggttaagtgttcttagttctttactattagttatgtatttatcattgtaaaataccttctatctcatttaatgctttttaccttgatttaaactgtatctcatactaagatcatatcctgttttccttggatagcatttgcccaaaatcttacatttttgtgttctgtgtttgtaagtcacttgttttagatgcagctctgatataatatgtagctgggttttgctctgtgatctaatcagtctatacattctacttatgttgctttaaaaaaatctttatgatccatgtttcctttgccttgttttttgtgattctttggttaatttaaaaggtttccatttttattctaggttatctttatgactataactttatataatcctttaactttctcacttttatttaatatgtttgattcccttccatgagaaatggcaaaactgagtatttttattttacatttatttaaatatttcttgagcacctactgttcttgaggtactattgttctagacattaatgatcagcaatgaacaaaacagatgaaaattcctgcctccatggagattacattctaatacaataaaatacatatttatatctgtgtattgactcattagttttaagtcattactttttccctctggctataaataagttcctatctcaaattatatccccagtcttccatcctgatagttttttgttattcattcctttgctttttgtagtttttttacttatgtatataaacctaaatggcattttatttttgaaaaactgagtagcatgtaccaaccatgctatataagaacaagtccatatgttcccaatattctagtatccaatatcaagtctatataatggcatgttttactttattctaccagcacttttgataacaccctcttgtttcttatagatgagtgatgtgtctgcaggaggagccactgtttttcctgaagttggagctagtgtttggcccaaaaaagtaagcctgtttgttttgtttttggtttattaattttttccctaaggaagagatgcacttgtattcatggtctaattaatgaattacatttttttttctttttcattttttgagacctgttctcgctctgttgcccaggctggagcccagcagtataaacatggctcactgcagctttgacctcctgggttcaagcctcagcctcccaaatagtggggactacaggtgcatgtcaccatgcccagctaatgtttaaattttttgtagagacagtgtctccctgtattgcccaggctggtcttgaactcttgggctcaagtgatcctcccacctcagcttcccaaaatgttgggattacaggcatgaacccctgtgcctgaccaaattacatttttaaaggtatttttatggtccttgccacgagtacttagaggtaatgaatgaccaggaattagtatttaaaatttttcatttctaaaatgggttctgcattgtgttttcccctccatcttgctatgtaagatatgttagctttcttttggcaaatacttttgttgtcaaacatttttatggtatttttcatatgatcaaaaacggttcttaaagtgatataaccatattttcagaattatattagaggaaaataaaatactgctatagagttcttccgcaggaacaaagggaaaattactgctgaaaacggccgggcacggtggctcacgtctgtaatcccagcactttgggaggccaagatgggcggatcatctgaggttaggagttcgagaccagcctgaccaacatggtgaaagcccgtctctactaaaaatacaaaattagccaggcctggtgttgcacgcctgtaatcccagctatttgagacgctgaggcaggagaatcacttcaacctgggaggtggaggttgcagtgagctgagatcgtgccattgcactccagcctgggcgatagagcaagactctgtctcaaaaaaaaaaaaaaagtaataactaccgaaagcaattacctggcattgtatacttggggataattgtgaattgttctccatagggaactgctgttttctggtataatctgtttgccagtggagaaggagattatagtacacggcatgcagcctgtccagtgctagttggcaacaaatggggtaaatatttcatatattctgcgaagataatgtaatttttgtttcttattttggaactattatctgtgtcttaaaaacaaaagcccccatgtttgcttaatatgattttaacattgtacaggattcagccaaacaagtgcctaatcataatacaaatttgaaatcagaattttgatgacagattttatttttaactatttttacttattccaagaaacaatgactgactcaaaattgaataagacaatatcttcccctcaaagggttaataatctgattgagacatactaatggattataatgtagtacatattaatacaaaaatgtaaacagaagatggtgactgcctaagtttggggagtcttcttcaaagctttttctttaaatttggtcctgaagatagaacagcagttttccaaacatgttagataccaggttctaatgtgaggctcgagtagcacctaatgtgcaaaatttaaagaggcactcactctcagtcagggacatgcaagtgcaggaccacatttttaaaaagtaaaaagaaacaggtaaaattagttttaatatctattaattagccccatgtatccatttcaatctgtgttactagccacatgttgagtggttacatacaggacattacaaggttaaggagtgaggcctgatcaggattttaaaatctccccttatgattatagtgtttaagaaccactggactagaatgaggagaggctagttggtgagagagagtttagaaagctgttttctgttgtctaagtgggagatgataatggcctggattaaagcatcagtgaaagggttggagagcaaatagatttgagagagatgtaaggaaaattgtcagggtttgatgaataaagtgtagatacaagggttgaagaaggaaaaagagttaagaattaaggttcctgctttagatattttgactgggttctatggtaccagagacaaaaaaaaaatagaaaattaactgcttttgggatacatttttacatggtatacattttttaaaggtattttggaaacttgatgagcatacaatagcaatggttgataagagagttgttcctttagagtgcaaagtttgtgttcattattgtctttgtattttggaggctgtactttgaaaacaatacataaagcaatattctactcttacctgtacctgtatcttaggtccatttgtgtctcatttcaagcctcacattgaacattggaaactgtaagaaatgcacatagactggcaaatatacatgtgtatacatacatgtatgtacatacacgcacacaagtgtgtacacatatgtatataggtatataaaatctgtgttttcagcatttagccaagtttttaagtagcatctgcctttatccggttttggtgttgaacttttatcccatgatgaaactttgttatagacctagcttttagaaactaattaaatactgattagattaagggggaaaattaatatattacttttctctcacagtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaa

SEQ ID NO: 193 - DNA, 8649 bp, Homo sapiens; identical to SEQ ID NO: 118

SEQ ID NO: 194 - DNA, 13283 bp, Homo sapiens
tgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggtggccgcacccaagcaggggtcgaaagcccgggtggatgcggaacaaggatatgataggccttaagggtgggggatacctctgggctcgaaatcggcgggcggtgcaaaactcgaggtccagttctcggagcccatagagccaaaaaagcctcagcttgtccggggcgggttcttgaaagacggaaagcggctgagtaccacgcggcttgcatttttctcttgggacgctcgagaggtgggctccgtgagggcagctgctgcctgcagattatagggagccctttgcgcatttattaagaagctactggtgtatctcgggctgcgctaggcacggcgcatgcaaagatgaagcaggcagcatcccagcccttccgcacctcagacggtcagttgagtaggatccgccggtaccaactcctccttttaacaaatagggagaccgaaagctaggagacagtcagggatctctaagttcccagtgagtaggaggcagaggtgaggtgtagaactcgtttttgcatgtctctcgcctctagacgcacccttccctcatcccatgccctcccacctccgcccctacattaaaggtagcattggatcccggggccgttcagtgaagctagcaggtgtccgcaggaactcccttccccctgccaggctagaaaccttacaaggctgtctagaaatagcagtgatttgtaaggagagacccggctccagcttggtgactctgggctgactgcctgcctagaggtcctctcggatttttgccctttggagtggtgtcaaaactagacgtgatactttggggatgcagcctgtgatatttcctccagcgaatgcagtgcagggttggattaacaaggtggaaagaattcgagggttccaccaagtagctattaactctagggctgcaggcctcaggccttctgcagctatttctacactccctgtactgaaactatttcttcatactgggcctgacaggcctttgcaacaaggatcacggccgaagccacaccgtgcgcctccctcccggttggttaacaggccctggtttctagtattgcgatttaaagtctggcgctggctgcgcgccagacctgggaggctgccagctaggcttcacgttgctggcgtctgcttcggggcattcattaggtctgaagtctgaatcccagctccctccctctcacccactgagctgcatagctccagattgcctctgcttacgggcggggcttctcagccttctgccttctggcccgatgcccgcttcccaacggccggaggccgctagactaatcggcttcgccctgcgcgctgtaatgcgcatgcgcacgcgcacaagttcctgggcccgcccatcttccggacttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaaggtatgggccttcactcttcacagaccctgtcattaggcctttcaactctcttttggcaaccattaggttttttcccctccctttttagtcatctctagtgatttatagtggcaaatacccccaaaggaagtaaaatagcttaaaaaaatctcttggttaataaacattaaagaagctgtagtgacactaaatgtttttcctcctatagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggtaagtgagagtctaccacactggaagcccataccttgaccccatcctctacccccactcctacccctagaactgtattattacatttcatgtaacagtatttagatttatgcactcattcggataactttctgtgaaacaaacttttgaaatatgataatacaccaaaagtgtatctgaaattaaaaagaatcaaaggttgtcaggctggagacccagttcctaaaattcattattctgtattaacatgcatggattgactaccaatgaaaaggaagggtccatgattttaaatgagccaaaattcttttaaagtgatttttgaattgaaaatgacaattcaaaaattgtcatttattggtaaaattatatgggaaatcataagttctcccactcaaatctcattgcccctgtgccttggatagcaattttgttatcaattatggagctaaaatttaattagaaaaaagaaattgtgagtaaagcactccttattacactattgaaagctgatttatatttaaaagaaattgaggcagcttacaacattaaaatgtctgaggcggggcacagtggctcatgcttgtaatgccagcactttaggaggctgaggtgggtggatcacgaggtcaggagatggagaccatcctggctaacacgatgaaaccccatctttactagaaatacaaaaaattagccgggcgtggtggcatacgcctatagtcccagctacttgggaggctgaggcaggagaattgcttgaacccaggaggtggaggtggcagtgacccgagatagcaccactccactccagcctgggcgacagtgagactccatctcaaaaaaaaaaatctgaagttaagatgtggagtgtctaataaaagtaaaatgatgaattctgggttctaaatagaaatggattcaagtgagaagggactaaagacagaaatgagctatgaaaaggcctcgtaacaacacaggtgactctacatatgttcttaggaaaggccacataatacaccaacttttattccttacccactagatgagaaattgatgctgttttccccacacctacaaaccgcctatgttttttctctgtgatggcctctggctcaggtgtgggtaagaagagtaactgacactcattatattgtggatgatttagggatagatctgcagcttgaataacttttggtaacgatagaccacatccagttgtattaaagctgttattggtgctcctggcctgaaatggacctatgaactttgagttgcaactataaggatattttttgccagtattatacactgcacaaacctatttatccataactgttagtattggttcatatatggaatcaaccagggaatagttcagattccatctctgaaagatgggcggaaatcagactttttaactttttaagttttttttttttgagacggaatctcgctttgttgccctggctggagtgcagtggcacgatcttggctcacttgacctcctgggttcaagtgattctcctgcctcagcctcccgagtagctgggactacaggcacccaccgccacgcctggctgatttttgtatttttagtagagacaggccttcaccatattggccaggctggtcttttttttttttttttttttttttttctgagaaggagtctcgccgtgtcgcccaggctagagtgcagtggcgtgaactccgctcactgctagctctgcctcccgggttcataccattctcctgtctcagcctcccaagtagctgggactacaggcacccaccaccacgcctggctaaatgtttgtattttttagtagagacggggtttcaccatgttagccaggatggtctcgatctcctgacctcgtgatccgcctaccttggcctcccaaagtgctgggattacaagcgtgagccaccgtgcctggcctggccaggctgtcttgaactcctgacctcaagtgatgtgcccgcctcggcctcccaaagtgttgggattacagatgtgagtcactatgcccggccagaacatttcttactaatttcaagtcttgatgctggtcaatatcacctagttaaatgaataacaacctaaaattggtgtgtaggatggaatttgagagagtagacagagcagttttatataattggaagttattctagcaactgccagtccagtgttctgcttccacatctgcagtggtggaactcctatagagctcgcttcagtggggagacagggctggagagagggtcagtgctatctatgtagggtgtaatctgtaagtcagcttttgaaatggggtgccctctactttgaatatctcgatactgtactaataaagtaacagaactctcctatgccagaaatatagaaatttttcatgctcttctaaaaatctagaagtggcaattttccatttaactaaagatttgatgtcttttaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggtagagtgcagttgcacaattatggctcaccacagcctcgaaccctgggctcaagcaatcctccttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaaatgttttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttacttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgtttgttaagtgtaaagctgtctctgcttaaaaacaagtccccctaccaccaccaccacacacacacacacacacacacacacacacacacacacacacacacacacacgaaattgcctgttcctgggctgataggacaccagttaagtagaaacaggagtatggaagagtgtgaacgttgagcttggggatcaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccaggtgaggcttttgactgcataaaaattgacaagctatagtaaaactgatagtatatgatatatatattatatatattttaaatattttgaaatattttaaaaaatacatttttaaaaatattttcgaatattattttaaaatatatatatatattttgaggcggagttttgctcttgtcgcccaggttggagtgcagtggcgcaatctgggctcactgcaacctctgcctcatgggttcaagcgattcttttgcctcagcctctcaagtagctgggattataagcgcctgccaccacacatggctaattttttatatttttagtagagacagggtttcaccatgttggccaggctggttttgaactcctggcctcaagcagtccatctgcctcccaaagtgctaggattacaggcgtgagccaccgtgcccagccacgcatatttattgattcatttatttttcttttttttttttttttttttttgagacggagtcttgctctgtcaccctggctggagtacagtggcttgatcttggctcactgcaagctccgcctcccgggttcatgccattctcctgcctcagcctcccgagtagctgggactacaggtgcccaccacgacgcctggctaattttttgtatttttagtagagacggggtttcatcaggttagccaggatggtctcgatctcctgacctcgtgatctgcccgccttggcctcccaaagtgctgggattacaggcgtgagccaccgtgcctggtgattcatttatttttcatgtttcatttcccttctaaggagatttgtgtgtgtgtgttttttgttttttaataattttaaaacattaaagggaatacaatgcctttaaatgtagttggagcttaaaattacctgcccaagatcttggataagggataagtttgtgaataattgttattctctttttttttttttttttttttgagacagtctcactttgtagctcaggctggagtgcagtggttcgatcttggctcactgcaacctctgcctcctgggttcaagcaattctcctgcctcagcctcccaagagctgggattacaggcacgtgccaccatgctcggctaatttttgaagttttagtagaaaggggtttcaccatgttgcccaggctggtctcaaattcctgagctcaggtgatccatctgcctcagcctcccaaagtattaggattacaggcgtgagccaccgtgcccgggcccataattgtctcttagttgataaacagtttattttcataaaactgttactatactttttttttgagagcatgtctcactctgtcgcccaagctggagggcaatgggatgatcatggcagctttgacctactaggctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtggtaagcataagttattttctttttgtttttgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatggcgagggggacgggaaatgaaatttctcttcttaccatggatatcttaagactgtagttcttaggatgtcttcagtcatttaatatcacagctgtttatacctgacttgtactgcctggccctgaaaagatgagcaaatccaaatgcacaaaagttatattatcacagttgaaaaatgttatgattaggttctgtatgctaagaaaaccccccttatgttctcatactatctttatatttcaaatatacatgggttaaacatttcaattggctagagaaacaggttagaatacagttaaaattcttagttttacataatgtaagtaaatgaaaatctaatctaaaagtgagtaatgactacattagtagtcttgaccatctaccaaaattgagtattcttcctccgaagataagagaattaggaaaatgaatcacaattactaatctgttggtacatgaaaataaatgtagtctgtactatttcttttagtgcctgtatggagtggaatgaatgttgctggtgtctctctgaagactctgcacccagatttagggactgataaagataaggaacagtggaaagaggttcacaagcaggtggttgagaggtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatggggtttcaccatgttagccaaaaaaaaaagaatgtgcctcaccttgcaaggcccaggccctaggatcacttgagctcaggagttcaaggccagcctgggcaacagggcaaaaccctgtctctacaataaatacacaaattagccaggcatggtggtgagcacctgtggtcctagctacttgagaggctgaggcaggaggatcgcatgagcctgggaggtcaaggctgcagtgaagcgagatcctgccactgcactccagagcctgctagcctgggtgacagagtaagagcctgtctcaaaggaaaaaaaaaattattgaaatagggaagctttcaacttggtggcattatttacctttgtggtcctgtgtggacctcaggtctatagaattaaaaaatgaatcatagccgggcatggtggctcatgcctgtaatcccagcactttgggaggccgaggcaggcagatcacgaggtcaggagatggagaccatcctggctaacacggtgaaaccccgtctctactaaaaatacaaaaaattagccgggcgtggtggcaggcgcctgtagtcccagctactcgggaggctgaggcaggagaatggcatgaacccggtagttggagcttgcagtgagccgagatcgcgccactgcactccagcctgggcgacagagcgagactccgtctcaaaaaaaaaagaatcataatctttagttcataacatattcttgtgattggtcaagcaaggccctcttgtttgtatttgtttaattaaataaaacctgtgaacccaccacccagctcaagaaagaaacacaatatctgtcaaataacattgttgaatcagaatttagtattctgctggtgtttggaaataagtggattctgtgctctttcccccagctatccctctgtccccctcacgctcccacttgagataatcctgagttaaggatgctatgttatcttggatttctttttaaaattcaatattatatttttaagaattatccaattttttttacaagtagctatagtttattttttgatagctgtgtaatattccattgtatcagtataccatgatttatccattcttctgttggaggacattggaaagattgtcatgtttttgctgttactaacagtactgttaatgaatatccctgtacataatatcctagcatacatgtgtgcaagggttattcttggtataatgcaacattgtggcattatttactgtaaaatgtgtattaatgaaaactttgtttttctttctttctcccaccctgctttttctgcctttacctatggtttcctatcatacagtgcttatgaggtgatcaaactcaaaggctacacatcctgggctattggactctctgtagcagatttggcagagagtataatgaagaatcttaggcgggtgcacccagtttccaccatgattaaggtaggtctatgtagtgatacgctgcatttgaatgctttttgctggctttttaaaaaagattcttctgagaaagattaatacaagtcttccattactgacttaagtgaaataaattaatgtacccacagcttaccttttttgaaagaaatggttgagctttaggattaatgtccattaggcctgttcaacacatagatacttgataatttgactacaaaaaagtcttgttcaattatgctgaggtaggtggaagactataaaagaaataaactatttctccattggggaaaatagaaattatattcaagttagcattatgttactatttttaatgactttcttttatactattaattaaatcataactgaacacctggaaaggaatttctacttatcaaagttttttatttttttgagacagtctccctctgtcacccaggctgcagtgcagtggccgatctcggctcaccgcaacctctgcctcccaggtttaagcgattcttctgcctcagcctcctaagtagctgggactacaggtgcgtgccaccacgcccggctactttttgtatttttagtagagatggagtttcaccatattggctaggctggtctcgaactcctgaccttgtgatccacccgcctcggcctccccgaatgctgggattgcaggtgtgagccaccgcacctggcctcaagttgtattttaaaatcttcataattaggccacacacagtgactgacagctgtaatgccagcactttggaaggccaagggcaggagaattgcttgagcccaggtgtttgagaccaccctaggcagtatagtgagatcttgcctctgttaaaaaaaaaaaaaaaaaaaaaggccatgtgcgggcagctgatgcctgtaatcccagcactttgggaggccaaggggtggatcacctgaggtcagtagttcaagaccagcctgaccaacatggtgaaaccctgtctctactaaaaatacagaattagccaggtgtggtggcaggcgcctgtaatcccagctacttgggagactgaggcagaagaatcacttgaacccaggaggtggaggttgcagtgagctgagatcgcaccattgcactccagcctgggcaacaagagtgaaactccatctcaaaagaaaaaaaaaagcggctgggctctgtggctcatgcttgtaaccccagcactttgggaggccaagaggtggatcacctgaggtcaagaatttgagaccaacctggccaacatggtgaaaccccatctgtactaaacatacaaaaattagccaagtgtggtggcgcacgcctgtagtcccagaaggctgaagcaggagaattacttgaaccctggaggtggaggttgcggtgagctgagatcgtgccactgcactccagcctgggcgacagagcgagactctgcctcaaaaaaaaattaaaaaaaaaaagctttataattatagagactgtaagtcttgggaaacctgggaatgcatagacaaaatgtgagattttttttttttcatttcatcttcagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtg

SEQ ID NO: 195 - DNA, 10247 bp, Homo sapiens; identical to SEQ ID NO: 154

SEQ ID NO: 196 - DNA, 195261 bp, Homo sapiens
gagttcaatcaattcagaacgtcgagatggagcccaactcactccaggtatttcgctctcctccgctcctccgatcccggcaccccccggcaccccccaaccccccagctcacccacacctctgcacccacccacaccccccacaaacttttcaccaaacttttaccctctgcatcccccaaaatcatttttattgtttaaaaaaatccctgcactgatcatacatacataatgtaattttaccgcctcaaatggggaggtgggtagaagtggcggtggggggccctgagtttttttttttttttttttagggaagcagaaaatttgtgggtgctattatttttccacccagcgttatatctgttgggtcgtctgtattaagagagtggatgtctgtgtgtaaatgtgtctgggaatagatgtttgtgctctgatggctacattatttatttggtgtttttttccccccctgcagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggtggtaaacctgtctgtccccctcttctttctttattatttttccccctagtaatgcttattacagggcaagcttgaaaatactgtattcacttctgcaggcaagcaggatcgactccttttttaaaggggtagcgccactagctggggctcgagtattttgccattgtcagagtttggctgtcagctttacaaagaggatccaactgctgattttagtcaagatcaaataacttgttcgagaagggttttgttcaaggatgtgtgtgtgtgtgtgtgtgtgtgtgtgtatgtgtgtgtgtgtgttcatttgctctcctgctattgcctcttgaacatcacatgctttttatattttttgccttttgaaaatttaccttcgtgtctggctcggtcgtgtctgggtggatttctttcggtgggtttcgatattgttcttttttcaaagtaagtatttgatatgtttaagagggcggaaattacgaaatggaggcagaatgagatcaaaagctattgagttggcaaagacgtgttgaataaagtgataaatgacaggtactggaataatacattcaaataacttgcagatctgcccgggcggatttcaaagcggtggtgtaacaggcacaaacacgttaagcattaacaactatctctcgcccactccccctccccccggacaagccatttgatgttctagtttgcaattactccacgcaaagtggacgtcctcctgcgcgatctttgggggtgtgtgggacgggggcgggggaggggagggcagaggggtgtgtgctcgcccactggccctgcgggtccagcgttctccgtgcccagacggcgctcccggggagggcggggaggggacagagcctccccggcacgtttctgggcggccgcgggggcgctcgccgcgctcccgggaggacgccggaggtgagcccgctgtcactgggcgccggggcggccgcctcccttcggctctgtcatttcatgtgtgaccgcagttctgcgggctcccctcctcagctgaccgacctcagcgccgtggtacctaccgaggggaactattttggggagtctgtgcccacggcgcagcggggagggagggcgcactgccgcctggcgaggctttgtgttgccaaagcgagagcagggtaatcaaacagacttttgagggcagctagtgctgtgccaggctctcgagctttcgaggtaggtgtaaggatctaaggatctttttgttaaatgaatggtttcccgtttaactcatcccggggctcggagctgccagtccttccagaattcctcggtttgatcgagttgatagtacttttggcattgctagttcactccctctccccaggatcgaattactcgtcagtggtctatgccggttaattactggagttcgtcgaaacgttcgccctcgaatctgccttttcggaaataagcccctcccacctccccgctcacctcccccctccaccctccccggccagctttggtttttaaatgttcatatttcccgacgtccgcctgcaattttaaaaaggtgttgtttggaaatactgtgaaaaatcctgcaacctaccaacaggttgagctctttccccctcccaaggtctggctcggccccctcccccgacccaactttcctgcgcagctgtcttcctccccctccctctccccctcctgatttcttattatttgcttttcaaatttattacttcaacatggcctgtgatctggaaaagggaaggattaaatatccagaaaagaactggtgcttaacagacttctgactaagtccaggaggaaattattcagtgttttatgggatattttgtggtcactcttttttggggggcggggaattgaaattgggatgttttttaaagaccctgagttgaccccacttggtacagttttaatttttgttggtgtaattaaatggtgaattctgatttaagaataaaggctatatttgccaaacgttgcatctgctagaagtgttgacagtgaatagatatatttttaaatacacgatttctttttaattgttcattatggggaattgaaagggaaccattgtaatgatctgtgcatttcgtcactgctatatgagccatacctgagaaaattaatcttgccatttaaaagtaaactctagggggtttgcggagggagatggctctatttataatcctcagctgcatatacatcgtctaatattatgcatgatttgttttttaatgctaacacggctggtaattagctgtatgattatacttgtatatttcattaggactttggctgatgtcattgtgaattattcagccatattaaaacaattttcaattgagataatgacacgcctcaaaattatgcaaatgcagactgcattgtgcaaaataattatgacaaatgtaaagcaggtagaaagtttcccaatgcagatcggttttccaccctggtgatgtcatttcccccctggcctaagttagtcattcattagcagaatagcagcagcagtcttctctggaggagagccttacagaaaccagcatttactgctggcacctagagggggcaacagggccctctcattaagaaatttgctttgttttcacttattccattaacttgtttatatacatttaaatgatttttattattgattttaaatagttttgaatgatgcatttgccatttgcaatgtgtaactgaaagagaaaggtttcttggtgatatgcactgttacttggagaaaatgttcagcacatttaatcagccagtacagtttattttaagtaaccaaatggagattaataatttcttgattgagctgacatcagcatccatttcgaaaggacagccaggactcagtatgctttttttggtttaagagaatcattctgcctttttatgatttcttgaaatgtaaagacgtcagttctaaaagcagaaaaatgatcattgtgcaagattagaaatagcgtccctgtgtggtttgctgtgatttgcagagggtttttttttttttggaatattttctcatgatttttgtaataaattgtgggaggctggataaggcaggactttgtacacccattttacagatggggacatagactcggaaaggttatgtggtttgtcaaaggtcaccaggctagaacccaggcctccttgaaattcaaggttatcttttctccccagtgaaacctacccttgaaagcagagcttgaattcatcatattacattctagaagtgtgtactaatgtgaacagtccctcagacattttagaattgtaactagttaatcagttttgccaaaggtcaccagatgtctaggtagcaaaactatccttatcctgtaaagttaagctaattctaatcagtggtatataatgataacagttatattttaatagttattaatgagcattaacaacttactattcattttaatgatgatggtgatgatttatatgcttatatacaccaatgccttcatatataatacttccagtgttcgcaactggtgttgaggaaaagcattcaagaaagtcacattttgattctgcagcttgctatttgcttaatcttgaacaaccataagtacttggaacctcagtttcttcagctgcaaaatgggaacaaagtagggatgactatagattgttggtgaagatcaagaggatttataggcaaaagagctttatatactataaagtacttaaataaatagaaaataattatgattatagtgacctttgttctagatattcttaattttataaacaataaaaaaaaaacttgtgtctgtgtggaggttcttggacctaaaaatgataccatcttaaattaccatgaaaatgaatagcagggccatgtgcaaggagttaagtgtctttagtaattacttagaattgccacattcagccactagctcttcagaggaggaaaatggcaaagtaggcgggtaattggttctgttactggataacttctgattacattcattttccaattgccaagtgcttaatctattggcagtataccctcttaaaatgggtggatatgcaagcttggatttcagcctgaccagccatcgctgggattttataagaaggtttgctggtcacctccaactgtgcttgtggatggctaagctaatgatgtccaggagtcaagatcaggcatacctggatgttacagattctagcatgcattccagatttctaaaagtgattcagttatcaccagcctcactactgaattaaaaaatgctaaaaatccatgttctggggcccctattgaagtctcctcaaatagaatctctagagttgggtccaggagtctgaattttaaatatttaaacagtctcagtctagctgtgttatcttgggcaagttctaaactctctgtgcctccgttttctcatctgtaaagtggaaatacggtccttatttcctaggattattttaaggattaaataagttaatatatgtaaaatgcatatgcccaaagttgacacatagtagatacttcaataatggttgactgttgttattatcattaatattagcattaatctcactgaggtttgaaaccactaccatggagcttactgaaaagtttttccgtgtgagggaatggcacctaggtgagtttgctaggacatgtgggcttccaaatcctaccgaatcaggctatctttcatctccatgttggctttagctgtgtcaccaaaataaaaagtgtcttaaggatttacattttagtgcagaagtaaactgtcaactggatcagcaggattttttttttcaaaagattgcctgatttggtcatatctggagttagacagacacattctggaatttagaaggtgctggattagtcttgctcttctctttggatagctcctcagtcttggtctatatccataaggtaattttttagagatttctgagacctcttaaatgaccacactggccttagacaattgttttaacttttttaagcctctgtttcttcctctgtaaaatggatttaatggcctcaactgtgctgggaatcagagataataatgaaaagggtctggaatctagcatagtatagtacctacacatgagagttcaatgaatagtggttgcacttataatagttattatttatttttagtaatcatcttaagctaagaaaaggatttatctttactctctaccaagcaggccttttagaacaaagataagaatgtaaagaattacatggagagaaattactggactgtgacaagagtcagccaagtaaggcctgaaggccaaatctggcccactgtctgtttttgtgaataaagttttattggaatgtggccatgctaatttgtttatggctgctctcaggctccaacagcagagttgagttgttttgacagttaccagatcgctgacaaagtagaaatatttattatctggctttgttaagaaaaacgttgctgacccctggcctatgcggttgatctgcaataaggtagatgattgtgtacctatttttctttcttgagttttggccattaaccagtaatagcagaaatataagaaacttaagtaatataagaaattgtacttcaatattatatcattaacgtttacatatccaatccaatttcaccattggttctaggacattaaaatttgagaatgagtgaaataatattaaattatattttgtatggttaagagcgaaactttagccaatattagtattgtctattttgagttaataaaaaactactcgtgaagttctatgtgctcagtactctgctaggtgaagagacagatgcaaaatagtttgcgatgtgaccctttttctgaataaatttatcagtcttgataaggagatgagatcaacatgtctaaaaatgtaaaagcaatatgagtcacaacacatcagtaaattgtgctgataatacatgtcataggcatccaaaggaaggctcccaaccatcatgttttttggaaaaagaattcattaaatttctcagatgttgattgaaaacctactgtgtgctggcacttggatacaagagattaaggagaatggcctcggccaggcatagtggctcacgcctgtaatcccagcactttgagaggccgaggcaggcagatcacgagattgagaacatcctggctaacatggtgaaaccccgtctctactaaaaatacaaaaaaattagctgggcgtggtggtgggcacctgtagtcccagctacttgggaggctgaggcaggagaatggcgtgaacccgggaggcagagcttgcagtgagccaagattgcaccactgcactccagcctgggcaacagagcaagactccatctcaaaaaaaaaaaaaaaaaaaaaaagaagaagaagaatggcctctgccctcaaggagttcccaaactgcctttgtagacagacagtgatcacagaaaaggccatcagactctttccatctgtgttccttagtttaagttgagacgaactgagatcactatttatttgtagcatttcttaatctttccggaaattagaaagtactgtcttcatctttgaattattacttcctggacacatatttgtagagcacctattatgtgccagatcctattctaggccctggggatgcagcatgaacaagacagacaaaaatcactgctcccagggagcttatagtccagtggttggttgtaacctgtcgtgcactttataccttgtgccttatagttatctgtgttcttttcctttaccttgtcacctgaccctatgctccccccaccatagtgctgttctcaggagcaggcagttgtgccttattcacctctgggtcctctgcaatatttagtgctattcagtgagtttttttttttttttttttttttttgagacggagtctcgctctgtcgcccaggctggagtgcagtggcgcgatctcggctcactgccagctccgcctcccgggttcacgccattctcctgcctcagcctccagagtagctgggactacaggcgccagccaccgcggccggctaattttttgtatttttagtaaagacggggtttcaccatgttggccaggatggtcccgatctcctgacctcgtgatccacccgccttggcctcccaaagtgctgggattacaggcgtcagccaccgcgcctggccttcagtgagtattttctgagtgactgaacgacataattaaaatgccttcttgcacacagtctaccttttttaagctttacccagtttctttctggcagatgaccagtgaccagtcattcacatgtgggccagatccacgaccccatctcacacttcttctttctcttccaaagtctgtagtcattttgcactgtagaatgtgaaaacatgggaagtggttttttcacaggggcactcaccaaagaaacaagcaaatatttgaaagattagactggaggcagcatctctgtttcgttgttaattttccagtctcagcagtcaacccataaaaagtcagggctttggggtggcaacctatgaaaagactagacttcaggaaagaagattcactcctcgcctggtgttggttggcagttcatacgagccagcatgtttttcaggctgatggtcttaactaagccacatgtttgatagtgcctcacaattgtaagcaattaaaacctctcgacaattagactgtcagacacatactaaggaaatgttatttttatgaaatacaagagtccatacatgtaaatacttcattattaattattaataaagcatgccattgttcatagtggcatctagtgatatatgactcaagctcatttatcaaagtctagttttaaccaatatccagaatataattgcttgaaccaaatgcattcacttgtcattttttatagccagtgtagttggatatttgccatcttctactcagaataatactgtagctagtgactacccgttgccttggcttttaaggaaatttaaaacaaatttatcgattgttggcttaaggattcattcacctctcagagatgtggtcatggattccctcatttcttgaagaatctacactgcacaaatccaaggatgcatttttctggccacgctgtgttcctcactgacttgctggagatgagaaccttggtcttagccctccagcatacatccctcatgccctggactatgagcatcagtatcgacaacacatttcaaacatgcagatgatgatgattattgaaagggtgctttagaatcatgctaatggcatcaatctctcgcacacacttgggtaaattaattctgcttttaaaatcagatgcactgttagcagcgttaaagatggatatttgacatttatcacgcagactaggatgggtggtttaattacgcgaattttctgtaggatctttgtggctgtataaatagacgcacagtggcgtgtgtccttggcatatgaccatcaggttcacagtcacatctccattcctgtgccccagtaagaaccccaggcggcaaaggccaaatgttgctagtcaatctagtgaccccataaacatcttttcccccacctttcttttctcatgactccaagcacacccgggctatgaaacaccccttccaccccatagttgagttccaagcctcatcagtggcactaaacattaaactcttgtctttgagaataatgggctttgctttctacaccctcaagcatgttgagctactgtgcaagctggaaaataaaaatgttctaattgtgtcttttaaataagcataggagtgaattaattagaccatattttgtctttagttgcttagttacacaatagtattcctgagcacgagtaagataaattggctctttttgtgctgcttgtcccttaatcataattactgtattgcttaggagagtaaagcatacatagattttgaattttttattaatagtcaaaaatatgcatatgatatataaagtatatgctgttcaacctgttttatatgtgggaagaagttttattgtggtggtaacatttgcattagttgctcaaagatgtagttctgggaaatacataattgaaatgtttttgaattgctttttctggccttttcaatcttattcaaaataatagtgcttccagtcctggagtagtcattctcatttgatttaacatctttctttgcactgcacgagcggcacccagttttaaccctgcagagcctagatgaagttctgtgattcataggccatacattgtgccttatgttttttggctcatgctcttggggcttggggggcagcgggcagaagggtgcctttgtcttgccgtcattattccaatgcccttcgcccttggctcacttccatgctccttaaggaaggttctagggttagagagtgtaagagtttttttagcatgagctggacaactatctgtgcttgcctgctggggtcttgcaaaatgaaatgttgctactggaagttgggtttctaaccgcctaccccaaccctccaccaaggagggcagcaggagttagacagcttgatatagttattgaacaatgagagagtctggattatgacccaggatacttgcttggtaaatgtatgtgaaaatcgactccattgttctattgtatttgaaaagcaagtaaattatttacagatatttgctaattaaagcatatgttgtttcacaagcacaaaggatcgcagtataactggagacaaagaactaagtgcaaataatttaaattcactaatactgtgtattcttcttaagggaggaatatgtttttaaaatgtgtatatatagggtgttggtcaaaaggtacaaacttttagttataagatattcatcatatatatgtgttcatcttctatctggagatctaatgtatagtatagtgactatagttaatagtactgtattgtatacttgaaaattgctaacagagtagatcttaagtgttgttaccacatcaaaaaaggataactgaggtgatgaatgttaataacttgattgtggtaatcttcatgatatatatgtacatcaaatcatcacattgtataccttaaatatatacaaccatcatattgtatactttaatgtatactatttttgttagtcaattatacttcaataaagctggagaaaataaaagtatatatataggcatatatataattatgtgtgtatatatatgcatgtttatatatatatatatatatgtatacacacatacacacacacacatacagataacttgtcctgttatctctgtatacattacacatatatacatactttttttttaacccttccaagggaagtctcgcatgctacagagatagcaagccaagttaccccccagttgcttgtcactaagcttgccctaagctctccaacggaagatgagatggaaacagttttgacagaatgctattttccctttggtttttgcttgccattatctagtttgagctcagctcagagtatcactagaaataaggcaaattagccagatacagtatcagagaataaaaatgttctcacccattcctttgtcctcagactttcctgaatgtgataggctcaggtttagttgtttttcttctgttttggcagtgttctggttggaaatttgcactgtggaaaagacgctggtgatacaaggcaaaaggcagaccagtgaaggtcagatgcagaaaaggtcattgataatgttctcagagaccttttcctggctggaactttggtgtatccattggtaaagctggtctctctggctgtgctgtctgccaacatgtttggttttaggcatggctagcttaaagtcccttggtattgttgataacgatggtcaagaagaattgccatggttatttaagagaaaggctcatgtctaatttgccatggacaattctgtagactcacaagataacagataaaagagactgagaagaacaaatccagccctctttatttaatagatgcagaacctaaggcccagaaaaatcttgggcatgtcctcagaactagagagtgacagaagtggaactaggattcagtgttctcaggcaccacagtctggtcggctgttttgtggggaaggggctgctctcttgaggtcatgtgctgaggaaagtaggcaagtgcttcccgtggctgtgttcttggtaggtcattccagtgccctgtcttataccagtgcatggtgccatgggggacatcacttttataaaacaactcatggagagtatggactttactggaatggcaagataccttgttttgtttgtttgtttgtttttgagatggagtttcgctctttttgcccaggctggagtacaatggcgcaatctcagctcaccgcaacctccgcctcccagattcaagcgattctcctgcctcagcctcctgagtagctgggattacaggcatgcaccaccatgtccggctaattttgtatttttaatagagacggggtttctccatgttggcgaggctggtcttgaactcccgacctcaggtgatccacccgcctcagcctcccaaagtgctgggattacaggcgtgagctaccgcgcccagccctggaatgacaggatacttagcagagagttagtgattacacagaagccaggattgatatccaggatcccagactggacatcaccttcatttctataatttttcctgaagccaggagggccctctaatgggatgctatttatgttggctgaagaaaagcttcgccaaaagttggcaatgttggtaataaatggaattggtacttatgcgaacatctgatactcatggatggtttcatcattcagaagtgtgtatctactatatgcctactatgtgtcagttctctgtgctgttaaaggagcagttaaagtgagtgcctactatgtatcagttctctgtgctggggatataatagtgaacaatgagtgactagtacacaaagatttctgttctcagagagcacattttctctcctatagtaagaaggaagaagcaacttgattaatttgtcccaaatggagggaaaaccatctccatacattgtagtcttaaaaccgaattcacgcttccttctagagtgctttctctgtgtattcacagcccagagaaaatgccccatatttctctttcccgaaaccatctgcaaaattttcacccactgtgttttcaatgaagtcaaagtcacaacattttccattaattcagtgaccacttatatgtcaggcattgcaaatacattaacatataaattaaatataaataaaatatctcatttaattctcatggatactctattatgtccgtagtattttgacatttccatactttgtaggtgatgcagctgaggccaacagaggttaaaggaacttgcccaaggtcacacataggtgagactcaagagtcgggattgaaacccatgttctcccgatgctgcgaagaccagtgggcgagcttagtttctcattataactttagaatatattgagaactctcaatatcagcactggggttttcactatatactgatgtattctttaattgagtctttatgaaagcttctttcctgctctttagggacttgcacagttgactgatacccagataatagtaatgccatgcacacaggtaatacactttgaaagggcactttacactccacatagcgcctttctcacatttcacaggagagaagtctcagactcagtacctccagcgtgactttgtgtgcagcccagcactgcgcactggagagagagaggtggaaaaccaggcagatcctgccgccatggagcttaccatcaggtggggaccacgcatagtatataaacttatcacaaacaaagggtgattctgtgatgtggtcaaggggatgaagggcaaatacaagtgcctatgtcaggggtacatgattttgtcggaaaggtctcaggaggcattttagaagaaatatcatttgagttgaggtctaaagggatctgggggtgaagattgggaagtttctaggcaagctgtatggtgagcactacctccctgcagaatggtttctgggctgggcttggccttggtgaattcgtagccaggttagagatgtccgtttgcccactggagggaccagttggtctaggtatcatctagacacctggggtgcatatttagagctaatgtacatcatttggctatggagatggttgaaaacacggcaagctaaggcaaactaaggcccataggccaactctggtctactatctgtctttgtttgtttgttttttgtttgtttgtttgtttgagacagagtctcgctctgtcgcccaggctagagtgcaatggcacgatctcagctcactgcaaccttcacctcccagattcaagtgattctcctgcctcagcctctggaatagctgggattacaggtgcccaccaccatgcctggctaatttttgtatttctagtagagactgggtttcaccatgttggtcaggcaggtcttgaactcctgacctcaagcagtccacccacctcagcctcccaaagtgctaggattacaggcgtgagccaccgtgtctagccttgtttgtttgtttttgagatagggtcttgctctgtcacccaggctggagtgcaaaggcgtggtcttgcctcatcgcaacctctgttgcccaggttcaagtgattcttgtgcctcagcctgccgagtagctgggattgcaggcaggtgccaccccacccagctaatttttatattttttttagtagagatggggttttgccatgttggccaggctggactacctgtttctgtaaataaagttttattagcacagagccatgcccacgtttacaaatggtctctggcagctttcgcactatagtggcagagttgggtggttgcagcagagactatataccacacagagcttaaaacatttactatctggcccttatataaaatgccaacccctcatttaaaataatattaataaaagtaatagtaaaactaggtcctgacagattaatatgtgacattttatttactcttcataacagtaatactgtgaggtagattctagtatcatctccattttgcgggagggtaatttgaaaggttaggtaacttgtccgggtttccaaattcactcacctggtgaatgacagagactgaatgggaactcaagctgttttaattccaaaatgcaggtgacagaaacattgtgctgtcctgtttacaagtagaggaaacgggaagtataagaaaagggtggtaaagttagctgaggttttactctgtgaaataaaactgcgcaacagctgtatccgtctttcaaggtcccatttaaaagccacctcctccttgaggtcttccattgactgtctaggaacaaggaagccacagaggcacaggtgtaagtgccctctgggtcaggcagataagatcaatgagtgactgggccaggtctgggagacaatatgatattcaggggaactggggagcgcacgactggtttgaggcatgcctctaaaatgttcctcttgagccaggtgccatggcacatgcctgtaatcccagctacttgggaggctaagcggggaggatcacttgaacccaggagttcagggtgaaccatgattgcaccactgcactccagcatgggcaacagagtaagatcctgtttctagtaaaaaaaaaaaaaaaaattaattaaaaaaataaaatgctcttcagtttctacctagcattgctgggcaggaatgtcagtctgagatattgacaaatctttccatttttcaagagaagccagaaacctagattttcatgtgattttagttgaccattctatttatttatttattatttatttaagacagagtctcgctctgtcgcccaggctggagtgcagtgatgccatctcggctcactgcaacctccacctcctgggttcaagtgattctctctacgtcagccccgctgagtagctgggattacaggaaagcaccaccacgcccggctaatttttgtattgttagtagagatgaggttttgccatgttggtcaggctggtctcactgcacctggcccaatccaatttttaaaacactctttgtgggccaaacaaaatgtgtcttctgtccagatgtggcccacaggctgccaccttgccatctctagagcaaagctttggactattacagtttttaaaactttctcatatttggcccattttctgtaactaaagcaaaaagaaccgttggtcccaaaggggctgttaaaaatggggtggggagagccacgtggataaagccagggctctggagtctggagggatggcaggaagagatgtgcaagaagaagagcttggctctgccctggagtctacatttaggcttgaggagggaggcagggaccagctgtggaaagaagtgcatgagtgtgaaggtgacctgtagccatcctggaaggtgtcctggagaaggggcccttgaaaacacctagggatggatgagggtaagagatgagaaaatcctaggcagaagcaaagccacaggcaagtaggaaggaaggacataccaataccggatatggtctggatttggtaagagagcacaggtctagtgggaaatgaggtagactgaggccagactgcaggggagcctagcatgtcatgtggacttgaatctgaaggcggtgctgctgaataaattcacatgtctgttttctctttctagttaaaatataaacccttagccttgaagagtagttaaatggagtgtgaatatttactctgccagttagtagctgtgtgtcatcttgaccaacttgcttaatctctctggcatctcagtttcttatctgtgaaatggcttgatcttgctgggctaagaatgtcaagtgagatgcttatgggcatagagcacaaaaccatgacctggcttatcctaggtctgcagcagatgttggttattgaccctgccctccctggtcagggaccacatcctaagttttgaagtcttagtgctaggctgttaataactccttaataactaatttatgggttgagatattggactattatttgaaaaacaggaactaaggaaactatcatattaaatagagttaaacttcctggtttttcatttaccccaaaagacttctcttgtgtttaggttcaacattttttatctatatctgtgatttccagtcactttgaaggagacatgttcaaatccattctattctgttccatgtagatgttaaaggtacattaggggccaggcacggtgactcatgcctgtaatcccagcacttttgggaggctgaggtgggcagatcacttgaggttaggagtttgtgaccagcctggccaacatggtgaaaccctgtctgtaccaaaaacacaaagattaactgggtgtggtggcatgcacctgtaatcccagctactcaggaggctgaggcaggagaatctcttgaacctgggaggcggagattgcagtgagacgagattgtgccactgcactgcaactccagtctgcgtgacagagcctgactccgtccccccccccccccccaaaaaaataaaaggtgcgttaggggacatctcttccattggccatgtcaaaattaactgagataggagtagatggagtcaagagacaaaactggcttcccagatgtttgatctaagtgccccaccctccaccctgccctttcatgatgcaaccatcaggaaacctggtattgatctgcaaaatgtgcaaaacattgaattcattttaaatatacccactattcctccatttcaaaaaagtttcctgtattttcttttcttaaaaacacccctaacttgaaaatttgcttcatccctttgtccccttccaccccaccgtcttcctcatttggggatgctcatggtagagggtgtattccaatccaactctgaaagatgcaaaaagcatcagccagaccatgtaaagggaaaggtcccagccaaaatggctggggggaatctcagaaggatcttccaaatagaggtagccttctgggccattaaatccttttgctttggattaatcccacagtgtatatcagatcactagaattcagatgaaaacactgctgtagtactcagtctcctcgccaaatgattccaaaatatataggttataaatacagaaaaaataactgaattcgatatttcttaagtgaaataatctgttccttgtgaatattctctgtaatagtctaatagtattttgtgctcctgggggctgagtgtgtttttagcaacaatgcattggttgtaaaatatgcatccctaactatctggacagacaagaaagagggctctagtaaaaagactgaagtttttttttttaaatgcagatcgtatgaatcacataaatggtggtgtctaaaaattatcaacaagctctgggtttgtttttatttctttacattataggtcctctttctcactccacatttttgatattactagatcagtaattcaagagacagccaagcaggtgttcacatctctcctgacccccagaattccttaaatgaccccttgaggcagtggagtaaaaacattctcagcatgtcagaatattgagatatctcagttgtcttaatttttttttctttttgccttaatctttacaggctttttgtgtgtccttttttctctctgcttaagccaagaggaatcttgcttcagtcttggccatgaagattgagggacaggaggacagggtctgcagattgtacttacagttaatacagttctaactgctcagctgtgccagctgacttttctaattggtctttaaaagatgaatctttgtttttttttttttttttcctgagaagtttcacttttgttgcccaggcaggagtgcaatggcgcaatctcggctcactacaacctccgcctcctgggttcaagcgatgctcctcaggcctcagcctcctgagtagctgggattacaggcgtgtgccaccatgcctgactaatttttttttgtatttttagtagagacaggtttcgccatgttggccaggctggtctcgaactcctgacctcaggttatccgcctgccttggcctcccaaataaaagatgactcttaaatgagtagatggaaaaaaaaggaagatggggcttggaattctcatatggtagttaagggcataacataatattgctcttgaaaaaatataacatttatatttttaaatatgggcctttgactataaccttttattcaattaaattcaatcaatatttattaggatgtaccagggtactatggggggtgataaggggatgaataaaatcagcttctttctctctagttagaggagatcaaacatgttcaagttagccatacttggcaagattatatggcctctttcatactgaaaaatacactcacattgttagatagtattcttagaaatttctatggatacccctccaaaatgaaagatctctcatacaggcagttgatttaggatttaggcagttgcatgaagtattttactattggtttgtcgtcaactctgcagaaaattatctaatttctaggaatacttgaaacatatttagcacctcattttacaaactttattttattgtcatacaatggtgtgtaaatgtgtcctgtgttaaagatggttgtatcggttatctattgttgtgtaacagattaccccagatttggtgtcttgttaaaacaacacttactatccacagtttctgtgggtggcaagtctgagtaaggcttagctgggtgcctcttgctaagggactctcaaagctccagtcaaggtgtcctccccagctgtggccatctgaaagctctgtagagggaggatctattaatacttcagacccactcacttgcctgttgacaggtctcagatctctcaggctgttggactgaggccctcagttcctctcaggcagtgggtctgggtctccctggcttccttgctgggccacatgggcctctccatagggcaactcaaacatggcaacggactcccctcagagtgtaaggtgtaggaatgagacacaagccatagtccttttataacctgatgctggaagtgacatcccatcacttttgcctaattctgtttgttagaagtgaggcattattgtctagcccacacccaagagcaggagattattaggaggttgcatataatctcaggggaccatcttcgaggccacctattacagctggcaacagagccaatcacttcagtgtacagctcatctgatgagggttgaaaggtattcttcttactctgttttacttttttccttttttcccttttattagttgtttatctatttatttatttttgagacagagtctcactctgtcacctgggtcggagtgcagtagtgtgaccacggctcactgcagcctcgacctccctggctcaagcgatcctcccacctcagccttccaaatagctgggaccacaggcgtgcaccactgtgcccggctaattttttgatacagtctccttggatggttcctcccaaatatctccccgctcttcagggcatataactatagatgacatacacagtagactgcagattgcctaatcttttgaagatttgttagtcttacagcatgtcaacaagccatatcgggtcttttttacatctaatgtcttgatcattgcatttggagagttttgctggaaagggcattgtgtctggttagatgagaaatcggcagagagaaatgaggaaggaggatcctgtagctgatataaacaggctccttaatgcataagaaaataggcatgtttgggccgggcatggtggctcacgcctgtaatcccagcactttgggaggccaaggcgggtggatcacctgaggtcaggagttcaagactagcctggccaacatgatgaaaccctgtctgtattaaaaatacaaaaattagctgggcgtggtggcacatgcttgtagtcccagctacttgggaggctgaggcaggagaatcgcttgaacccgggaggtggaggttgcagtgagccgagatcatgccactgcactccagcctgggtgacagagtgagactccgtctcaaaaaaagaaaataggtatgtttcatgcacagtggttgaggagaggctttaaatcatgttggcatacggccatggaaagaagacctaaaaatccacatgagagggattcttgtcccaggtgtgtttctcatgagtgtatctacaagaggtgagcatctcctggccctccttccatgttgtgtatacgtcaggagagcagctggtctgccatcttttaaattctgtgcaagttaactgttttgtgagaagactcattgatctttctttctggaagtgtgcagtttggtcttcagcaaagtgctcacaacatacatatgtaggcattagagctttgagaaaaaggtagtattaaacagattctggccaatgtttttttaatgcataatgatgttcagtgatactggttaatttttaataatggaaattgatttatggggtggcttccatgttaaacctagtgggaacttaaagaaaaggggtctggattcaaattgaggagcatgcatcagcagtaagacatacacatggggcatgttgtatgtttttctttttttagccttaaatgtaaccatgtaccacgtttctcccagtggcttcacgtgtgctgttcctctgcccacagtgtcctgtgttcttccccatcttccctcacctcttaacttggctgcttccttttctttctcagggtctgagcagagagacctttcctgaccactcaatttcagtcatccccgcttccaccccttgccccatcaatgcctcttctcgtccttttgcatcagattttgtttactatctggctcttctacccagtccacacatacatgactatccgctctagaggagtaggggttttgtctgttttattcctggctgtaaccccagtgcctggcatagagtcggtgttcaataaatatttgttgaactgataaaatcacttatgaccatttttcattatataaaccacatttagctaagggcttacgtttactgtccatctcccccaccttggctgctgtatgactcagagaggcttgttccccagctgttcctagtgcctagcacagctcagaatagatgcttgcaacactgaagatgaaagagtgagtgaactctctgacaaaggactagaaggagtgtgagctgcacttcccaggaaaggagcaggagactctgcctgggcgctgtgtgtttctgaagggcagcaccatgtcttatccatccttatctctgtagctgatactcagcccagtgcttggcacagagcagagagtcaatacaaggtaattggatcagattgaattgagtttgggaaaagctagaacaaaatctctcctgacaacaacactggatgaagctcagcttgtgaatgctctcttaaaggtggcagagatgactcctcctggattccctcctgtgattgttttgtcaggatgcctagtagtatgcatctattcattcatttattcattctttctttaagctccacctgcaaggatgcagagcacagggcatggaaagctgcacaagttttcagccccacctttagaaagcatgtcttgaggaaaagttaggctgtattctctggcttgtacaacctccccgaggaggcaaaagagttggactcaggcggttgtagttgcttgagtctgtcctttgtgttggcctccacaccacagtcgttgaacaggagtagaaaaagcaccaactgtggttgcaaattggcttttgcattaatcctggcttattgaaaaacactcaatatttttccaaactgaatttagggcttttgactgaagcctgaatcatttactgcagcagagcatatcactagtctaggaaaaactagaacttataaatacaaagtccgtttaagtaatccaatataggataattacattattaaataaagctatgggtctcaaattatcccactgcctttgtacatgtgaggataataatgtgaactgtgctaagtgaacagagtaaaaaaatttaacaagaatggagtgtgtctaaatcatatgtttatgtttaaacagaggctacagaaaacaggaagatttactcggtttgtacattaaagtgtcctaaataggcataaggctgtcagtgattcttggaagactgctcttctaattaatggcaacggtatattgagactctgtgccagatgaccagtaagctttaataattcagattttcatacaccaacaggggccaagggttttcttcttcctttgagggtctttatgggatagactctgctggatgatgtacctgggcagaaggtcatgtgcctgcaaaagtggatgaaaaaggctgggcatagtggctcatgcttgtatcccagcactctaggaagctgaggcgggtggatcacttaaaggtcaggagtttgagaccagcctggccaacattgtgaaaccctgttcctactgaaaatacaaaaaatggctggtcatggtggcacatacctgtaatcccagctactcgggaggctgaggcaggataatcacttgaacccgggaggcagaggttgtagtgagcagagatcgcaccactgcactctagcctgggcgacagagactctgtctccaagaaaaaaaaaattaaatggtcaaaaaaatcagatgttaaagtaatggtcgagtcattccggattgggtggtggttgggtttgggctttattgttacggtttttgcttttattgggtgttcttacatatggcttaactgagcataacactggaattgggctcatttatcttctttgttaatgttttaatggccagagctaactgggtgccaagctagcttttattatggcaacctgaaaggagttaaaaaaaaaatagaccatggagtttacaccctattaatttggccagagaaaaagtaggcaggcttaactaacactgatataagtaaagcctcttctttgcatatcaaatgcttgactgtttagagagaaagtatgtaggacactgggatgcaattttctgctctctgtgtaagttgtcttttattttagggaggaaaaaggtacatgcatggtaagcccaagaggaaagaaatggaacagggaattatgagagggtgtttctaggactttctctggagatggtcaggggagcaggctgcagccgaccaggttttagattagtgtgtattaaaaatgtatttaggaacataaaatatttaggatttttgaattacttgtttgatacgcaaatgccgttggctataaccatgaaggatggtcgcgttacatttaacaaagcgtgcctcagagcaatcttctgtttgtttactccctcctcttgtgcccggatggatttccaaaattcatcgagccacaggcgtcaaagatctggtgagcaggatggaaaaggttggaagaggaggggctagcttgggaaattagaacccaatacactaaagagcctccgtggcaaatcatttcatcatgttaagggagtcaaattaaatcttagcacatacttcagagtctatcttcattgctctgacaacagaaaattctttacatttttaactagcacatgagtggtgatttctgccgtctttctttgggaacaaaaacacgataaaaattaaaaattaaaatcctttttgtgaagtgacttgaaatcccattcaccccagggaattggcaggaggtggggaaaggtgcatttgtcccagggagggagtaggttgggatgtgactactgtcaaggtttaaatgaccagttttccagaaagaagatgatgctaccatgctggtttctggttccacttcagttttttcatctctaaaatgagttaagaccacctatctcagaaagtccttatagggattagatgggataatgtctattaaattcgtagactagtgtctgtgtcaagtaaagcatctctgagttttctgcagctgtgtccttgagagctggggaggatgagaaacccaggtatttaattttattattattattgttatattttatttatttatttatttttttgagacagagtctcgctctgtcaccaggctggagtgcagtggcacgatctcagctcgctgcaaccttctcctccctggttcaggtgattctcctgcctcagcctcccaagtagctgggactacaggcgtgcaccaccacacccagctagtttttgggtttttttgtattttgtatttttaatagagatggggtttcatcgtgttggccaggatggtcttgatctcctgacctcgtgatctgcccgcctcggcctcccaaagtgctgggattacaggcgtgagccaccgtgcctggcctcaagcctattattaggttggtgcaaaagtaattgcggtttttgccattgaaagtaatggcaaaaaccacaatgacttttacagcaatctaataattgtcttctggtccaaccttcccttggagataccagcaggagttacaggaccattattgttcctagacaaagaattaagaagagttaggaacatgcacagttacccacaagggacatttgaatcccacttgccctcccttcattttctgctcaagagataatatataatagtaatcaccattatttcatggatgcctactctgtgttgaccattgtattgtaacaactacagcatcctaactaccctatgtagttggttactttatcctattttccccattttttttatatgagaccttgacaagtccaagaataacatagacttgccagggtctcatctaaaaaatgaggaaaataggctaaaataacacagtagagctgcacttgaacctcagtccatcagactcaaaagccagggttttctcagctctcccttagtttcttccaacatggtacattcagagatgatgtaccattaaaataagcacttggtgctttgggcccaacacaggccttggctctttgggaagtacaagagaagtggaagttaggcaaggaaacctgcctctaaaaaatatttgcaattgaggtgtttactgtagaagacagaattatgcaattcagcatcaaatactagtgcctaataaagatttaacattatgtcacaggtaataagaacagtaagtcccagttcagggaccaacttagatgagatagctttttattttgcctaataaggacattcaaaaacaactaccagcatcttttgatatcatcatttcagagaaaataaaggatattataataccgcatgaaagaaacgagaagggataaaagtctccagcggagagtgtgtggagtccctccatatcagggccactcctttcttttctctgctttctgccctgggaggctgacctatgcgggctccattaacagaggccctgggcactgtggtttccggtggggtttactcatagaggtgctgggagcgggaggaagggagaagtgtggaggcaggtatttattccctgttgcttcccttcaggctggtcccttcaggctggtggcatccctttaaggaagagtcattgtgtttggtagaagggtcttctctattctggtaatcactcccacccctctgcggccctttagcccaggagtggtgatggctgagctgctccagcccaggttcctgtactgtgtatctcttacgattcctttacatcccaacacctctgtcacttgttccagtgtaaaacctccccttgaattattattactatcattattattattgagacagggtctcaactctgtcacctaggctggagtgcagtagcacaatcatggctcaccgcagcctcaacttcctgggctcaggtgatcctcccatctcagcctcctgagtagctgagactacaggcacctgccaccatgcctggctcatttttgtattttttgtagagattgggttttgtacaggctgatcttgaactcctgggctcaagcaatccacccaccttggcctcccaaagtgctgggattacaggcatgagccaccgtacctgccccccaacttgaattattattactcaagtattccattggtttcctgttgggattctgactgatacaaggagagtccttgaaatctagcaagtttagcttaatgaagcttgactgcattgtccccatttttctcatttcaccgctgaccagtgaaagcttcatcttgtttgatccatattaccatcctgtcttttctgactttcttggattccgagtggcaactacttatctgtagtgtgaaacctttttactccctctgtagatatcccattagcagaatacactaatgtgtaatggggagaacagttgggcaaactggtaggtacctcaaattgcagtgtgtctgagggaggcttgaaagcaagggagtggccaaaccacccaggcttcgaggtggtacattcttccccctacccgtctccattggtgcacaccagaggcacatgcacctgccaggaatggttccgtcaggacacaagctgaagtggttgtagttagtctgtctaaaagttgactcttaacagagttccttcatttttaatttctatcttaattaaagtttgccaccctcatgcaactagttggactagtatttcggtgtcacaatttatttagctaatacctcatattgttgtttttgtgttcccaacatttatcatgtttcaaatgctacaaagtacattttgaaagcctgggatgttcagggaagactgaggtgagtatgccatgctttcctgttcttgttccatcccctccctgccaacccgtctgatattacacttgtgcatttattgtccttgggatgctaggtgattatagctctccttaccaatgatctgttactgggtacaacacagtatgataagaaaagttcatgttctttctctggagggatgccatattagtaaggatataggttcagctgtgtgtaacagagactcgtatattatagttgcttagatacattgggagttcaaaatctcttatcatggtacagacgtagatggctcacagggctagtgtggtggctttgctctgtgaggttgtctagggactgggctcctttttctcctgagcaatttgccctcattcttatggtccaaagctacacttattccctttgagggaattacatccgggaaggacatcactaatactcatatcctgtagtcataatttggtcacgtgactgcacctggctgtaaaaggaagcagaaaaaggacgcctttattctccacccagcaatttagcagtttattattagaaaggaagaatagatattatggagaggttagccacagttgggaagtgttaaagtctccttgtaccaggcaagatattttcttacaagtaagtcaaagggaaggctgtgcagttccgctgagcttgagttgactctgaggcatccaaattgataacaagggactagagtgtggatgaatttttgggaccaaacagtacaatgtagtcatgggctttaggggtgagcactggaatccccatagagaatgatttctttaaggagtgatatgcagagaaagaagaccacatcccagattgcatctaagtatatgtttcatacattttcccagttgggagatggaatgaggaagaagagaaattgaataaagcaaagaaatgtagaggtgatagatgttgggtaggtgttctccaagggtctcttgcatatgtacacatcttgtgagcaaagccactgactgtctgtgttctggactgtcttttcaaagatctttatatagtgaatagcattggaagacaaaggtagtgtttttccttagaacaagagcaggcatgcttactgtccagtattaaagatacaggttctcggccaggtgcggtggctcacacctgtaatcctagcactttgggagggcgaggcgggcggatcatgaggtcaggagatcgagaccatcctggctaacacggtgaaactccgtctctactaaaaatacaaaaaattagccgggtgtgatggcgggcacctgtagtcccagctactcgggaggctgaggcaggagaatggcgtgaacccgggaggcagagcttgcagtgaaccgagatggcaccactgcactccagcctgggcgacagagcgagactccgcctcaaaaaataaataaataaataaataaataaataagatacaggttctctatgctcaggactcttctccagtagtgcaccccattgtgtgaaaaggtatcatctatccctcttcacatctccttttgggaactgagtattaaagaaccaccacaaacgctggtacattgactattgctattactgtgagtaataaaccattttttgtctctggccaggagtctcatggcttctgccaacatccatgaaactggcaggtgaacttggaagtctgaaaaaagggtaaaaatctcagacccttcacagttcttaacaggaaggagagtttcaagtcaaaattagggttgttcattaccaaatgctacaaagaagttaaagaaattgaagaataagaaaacgccttgggttagtgacataataccatggctctcaaagtttcggactcaggaccctttacactcaacttattgagggccccaaggagcttttgtttatgtaggttatacctactgatatttactacagtaggaattaaaactgagaaataattttaaaatatctattaattcatttaaaaattatgacatccacatgcacaaaaatacatcaagctgaacctcataacttatacacaattaagtgaaaacagatcatatttctaaaagtaaaatgtaaacctataaaacttttagaacagaacataggagaaactcattatgacctgggataggcaaagagttcatagatataatggcaagccacaatccataaaagaaaaaaaatctaactggacttaatcaaaatataaaacctttgctttgtgaaagacactattacgagaattttaaaacaagctacaaaataggagaaagtggtttcaaaccacatatctgacaaaaagttaaaagaactctcaaaactcaagtgtaagaaaacaaataaccaaatgggcagaagacttaaacacacatttcaccaaaaaggacatgcagttggtgagttagcacctgaagaagatgtttgacatcattagtcattagagagatgaccatttaaaacacaatgagaaactaccacatacatattaggataataattattaattattaataatcaattaattaacagtgatagtgtcaagtactggcaaggatggggagcaactggaactctcatgcattgctgttgggaatgtaaaatggtacagccactctggaaaacagttgggcagtctgtagaaaaattacatccatacttaccatatgactcagcaatctgtctccaaggtgtttactctagagaattgaaaatatgggttcacacaaaaacctgtgcgggcataccttagagataatgcaggtttggtttcagaccactgcaagaaaatgaatatcgcaataaagctagtcacatgactgttttggtttcctagcgcgtataaaagttacatttacaccatactgtagtctgctaaatgtgcgttagcaatatgtctaaaaaaaaagtacataccataatttaaaaataccttattgccaataaatgctgaagatcatctgagtcttccgcaagttgtaattttttttgcttgtggaagatctgggcttgatgttgatggcagctgactgatcagggtcgtggttgctgaaggttagggtgactgtggcaattccttttttctttttctttttctttttctttttttttttttttgagacagaatctcactctgtcacccaggctggagtgcagtggtgcattaatggttcactgcagcctcgacttcccaggctcaagtgatccttccacctcagcccctgagtagctggaactatgggtgtgtgccaccacacctggctaatttttgttgctgttgagatgcagtttcgccatgttgcccaggctggtctcaaaatcacaatttcttaaaatgccatgcattggttgacacttcatttcacgaaagattactctgtagtatgcagtgctgcttgattggattttacccacaggtagaatttctttcaaaattggagtcaaccctctcaaaccctgccactgcctttatcaactaacttgacgtaatattctgaactttttgtggtcatttcagcaatgttcacaaatcccagcacttcgggaggatgaggaaagaggattgcttgaggctaggagtttgagagcaacctaagcaacacagtgaaactcctctctaaaaataaatttaaaaatttagccaggcctgtagtcccacctattcgggaggctgaagtgagaagatagcttgaggccaggagttcaggccatatggtgccaatgcactccaacctggccaacagagccagacccaactcaaaagaacaaaaacaaaacaaaacaaaaaaacattgttgacagcatcttcaccaacagtagattttatgtcaagaaacccctttctttactcattcataagaagtagctcctcttcatctgttcaagtttagtcatgagattgcagcaattcattcacatctttgggctccacttctaattctagttatcttattgtttccaccacctctgcagttacttcttccactgaagtcttaaattcctgaaagtcgtcacctatgagggttgaatcaatgccttccaaacttctgttaatattgatgttttgacccactttcatgaatctgaatgtacttaatggcatctagaatagtgaatgctttctagaaggttttccgtttactttgcctagatctatcagaggaatcactgtggcagctatagcttcataaagtatatttcttatataatgatactcgtaagtcaaagttactccttgatccatggactgcagaatagatgttgtgttagcaggcataaaaacaacattcatctctttgtacatctccatcagaaccttggatgtcaataagcagtcatatttgtaaagaaatctcttattctgagcaataggtctcaacagcaggcttaaaattttcagtaaaccctgctgtaaacagatgtgctctcaatccagcttcattttttcatttatagagcacagagagcatagatttagcataatcctgaaaggccctaggattttcagaatggtaaatgagcattggcttcaacttaaaatcaccagctgcattagcccctaacagaagaatcagcctgtcctctgaagctttgaagctggcattgacatctcactatctatgaaagtcctagatggtcttttttgcccaatataaggctgtttcatcttctattgaaaatctgttgtttagtgtagctaccttcaattatcttagctagatcttctggtaaacttgctgcaatttctacatcagcatttcctgctttaccgtgtacttgaaagttacagaggcagcttctttccttaaacctcatgaatcaacctctgttagcttccaacctttattttgcagcttcctcaccacttttagctttcgtagaattgaagagagttagggccctgctctggattaggctttggtttaagggaatattgtggcctgtttgatctttctacccagaccactaaaactttctccatatcagcagtaagtctgttttgccttcttatcatttgtatgctcactggagtagtgctttgaatttcctttaagagcttttcctttgcattcacaacatggttaactggcgcaagaggcctagctttcagcctctcttgggttttgacatgccttcctcactaagcttaattatttctagcttttgatttaaagggagaggcatgggactcctactttcacttgaacacttagaggccattgtagggttattaattagcccattattgttaagtcttatggaataggtaggcaggaggagagggagatagactggggaaaaaggcaggtcagtggagcagtcagaacacaaaacagttgtcagtgaagtttgccaccttatatctgcatggtttgtggcatctccaaacaattacaatagtaatattaaagatcactgatcggctgggtgcggtggctcacacctgtaatcccagcactttgggagtctgaggcgggtggatcatgaggtcaggagttcgaggccagcctgaccaacatggtgaaaccccgtctctactaaaaatacaaaaattagctgggcatggtggcacatgcctgtaatcccagctactcgggaggctgaggcaagagaattgtctgaatcccggaggcggaggttgcagtgagccgagattgcaccattgcactccagcctgggcaacagagcaagactctgattaaaaaaaaaaaaaaaaagattacagatcaacatactggatataacaataatgacaagttttgaaatatcacaagaattaccaaaatgtgacctggagacacaaagcgagcacctcctgttggaaaaatggggccgatagactttcttggcacaacttgcttcccacagactttcaatttgtaaaaaatgcaatatctgtgaagtgcagtaaagtgaagcacaataaaaagaggtatgcccgtacatggaaatttatagcagctctgtttgtaatcaccaaaattgaaacaaaccagatgtccctcagtcagtgcgtggataaacaaactttgggacacaaacataccatggatacataagaactctgcagaaaggaataagctatcgatacaagcagggtcatggatggatggatctcaaaggcattattctttgaggctgctttaagaagcagcctcaaagattttgtactgtatgattcaatttatatgacattttaggaaagaaaaaactataccaagaacaaatcagtagttgccaggagctggtggggagtggagggagagggtgactactaagaattaatatgaggggttttgagggtgagggactagtctgtatcctgacaatatagtcgtggtagttatatgaatctatccatgtgttaaaattcgcagaactgtacaccaaaaaaggaaattttactgtaagttaatttaaaaataaaataaaatagcaatataaactcattatgtaaatgtaacgcactttttatgaaagttaaccatattttcaaaaacaacaaaaaattagtaagaacagtggcattgttttacattttttgtaaatctctttactgtctagctttatatagagagcggagttctcatatctccttctgcattcactctgttgtgatatcacatgtcacatcgtttctggaaaaccctactatatatacacttgaaagaggatgagagtgaaaaaagccagtaatgtcttagtagttttaggatcattgttttgaccctgtggaccatctgaaatggtctcagagattcccgagggtttctgaacccactttgaaaaccaatgatataacacattgttccaaattttattttcatagcatcttgacttttatttttctggctatatccacatgttccctgtgtttacttaatgcctatgttcaaattggcccttttttaaaacttgctatatctcctataaatagaaaaccagtaccaccttcccataaatagtaaatacaaaacaaataagcaatgaaaaacttaatatacattttaaaagtttatttctgggccgggtgcggtggctcacgcctgtaatcccagcgccctgggaggccaaggcaggcagatcaccagaggtcaggagttcgagaccatcctggccaacatggtgaaaccctgtctctactaaaagtacaaagattagccaggcgtgatggcaggcacctgtaatcccagttactaaggaggctgaggcaggagaatcgcttgaacctgagaggcagaggttgcaggagctgagatcgtgccactgcacttcagcctgggctacagagtgagactccgtctcaaataaataaattaatttaattaaattaaaagtctacctgtgaaccatctaaaatcatctctgcatgccacggtttggaaaacaccaatttagagaagaaataacaatgatcatgatagctaattctgacatgctacttcatttgtatcaacccattgagtcctggcaattactgctggacaaggcagacagaattattataaaacctgggtttccctttttttcttccccaaaaaaaaaaaaaaaagaaagaaaaaaaaactttgaagtacaaggaggctgaagaagttgctcagtgttccacagcaagtaaattccggggctggaatttgaacccaagcaatctggctgcagagtccaagatgctgtcttggcagataggaaacctggatctttgttcaagtcctgccgtcagttggttcttggacatgtcactgaacctcactgtcctcatcagtaaaatgagaaaggtgaactaaatcaatgttacaagtttaaatgtctggtgcccacgggggccagatagttaagggaaaactggactgaatacaatgcaatagggagtggtggggattttacatcttgtctgaagaaggcagcttctatcagtttcaactgttttttatttttattttttggcctttattttattttatgagagaagattgaggtctgggtatttttgcctaaagtttcccaagttttagaacacttggaagggcccgccatgcacatgggctgactggtttgtgacttcttgactggatgagctcctcttgacttagaggatttatgattaaatgagctgtttttggacaatggtagaaactaaatccaaattacagaaataggcagtttaaaacaatgacgaaaggggataaggacttagaacgtggctcaacacagcttacataaatattgattaagagctgggttaattgaaaagccaaggtacattaatagaataacaaagtgtatttctttgtgttccttttgtgttgtattagagtaaatcagcaatatttatccagtgctaattctcagtttgcagagagctaatgtaatcatgagatgagcttattgaaattcttttcttagacatagagacttgcccaagaatggtgagtattaggaactttagtcagcacttgctcagaatagtaaatgcgaacatgtgatttatgccattgtgtgcacaaagtaatgtttcctgagacattttctatatatatgttggctactttttgttttcttgtggtgggaggggggtgttggcttgctgtttccccctcctctccttatcagatttccttctatggcatttgacaatgttgcagggccagtttctctgtgaatccacagtaaaacatactggtggtttcacaattaagccaaacttgggtttatggcttatgcatgtttatgtgaattcctgcatttgtttttatgtgtgtgtgtgtattcatgaaagatctgtttgagagagggagaaaaagggaggacaaaacctatagactgaatcataaaagatgggtttattcattaatgacatcataaggatagtattttctcttggttaatatactatttgtttggagggtgttgtaagccatccagagatagtcatgccatttcttggaaaagatctgaagcaactagtaattgaaatgataatcatttgatcagagagctatttgaaaataacactcatctacaaacttgtctcttctgggaaactgtatttagtcaaaatgttgccaaattctctctttactaatgttgagactgatacacctaattattttccagtacattctaaacttgatttctggtgtcacctgtccagaagctgttcccatatgctttgaaacaatatctagcctgactttattctgacatttaataatcaccatgaaatagctataaaatgcatgacaactacagatcttttatttcaagaggatggtgtggtgaatctgagggaaatcatccgttgaaatggtactttgtaatgggccccattgtttataaagtactcaaattttttcttgagcgcacgatagaaacacagtttccactttgtctcccatttagtggtagttcatatttaatcatgataagggaaaggattccattactaaagttttacttttcatttttgatagagtatttgttactctgctgctgcctaatagactttcttctcagaagcagcttggaactcaatgaggaaaattgaaattttagatcctaccttaaaacatcagaaaaaaaaaaaaaccctcaacccagggcttcttattatgtgaagcttaccctaataacctttttttgttcgaattggagaagtgtgtgtgtgtgtgtgtgtgtgtgtgtgtgtgtgtgtgtcggtggggcagggggaggaggaaaaagtcatgtttggggaggaggaaaaagtcatgtttaacagcaaaattagccaaaatcagttgtgaattccttttgtttaatagctttgagacatcttcctgttgttgtttgtcaaaaatatttctaagattttgtaatcttaggggttttcacagccaagctttcttcagaaatgtgaaataaaagaaatgaaagaagtcagttcaagttgaaatgtcagatgcttaaataacttaacttaaaacccagtgagatgatcttcttgagccttttccaaagaatctttgggtgaaggggcctccctttgttccatgtatggatgtctattaaagatcttgctgaattaattctgagtcagaaaagttggttgtttcctagaagcaattagagatgcttaacattcaaatttatgatccagaggagaaacttgcatttcaactacttttcttaaattcaaagactttttcctcactcaccctctcaccctctaccccatctgtattaaaagaaaaaatcagttcatttctcagcttacaaagtttttgagaaacatgagaatgtgtaagtttctttcagtgggaagcacataacatttatgaagtatttcttttgggattacatcacagttttatttaatttttaggacaaaagttaaattcaatatttgtgtataagccaagggaaaatgtaccataaacataggaatttgggggtgagtcagagttccaagaatcctagatttacttagaccatttatgtagagacaggctcaccattagtcatctagctttcactttttacatttgcaattaattacacctaaaaactagctttcacccaagtggtcagctaggtagagtgtgaacttgggcaaccaacattaaaaatggcttattagaattactgtcctatttttggatactttctaattgtataacaaacataaaaattattccttaactaaacaactagcagtgaaaaaccattgaaatgaagtgagttactaaagattctgtgtcaccagaatgcacacagtctccttgcattaggttaaaccactcacatggcatttcagatgggccttgtggagagtggatcatttccctcaaacctataaataacgttttttgttcttccccaaccacctcttgtaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggtaaatatgacttgtaattttaaatctaatgtgtgggcgtatatagtaacttttcggttgaagatttttctggaaacactatcatttatatataaatgtatttcaaatttctttaacctcaaagggtcctaagaatatggatggagagatgactggatgggtaagggatgagtgttacctgttggatcaaaggaccttttatgtatggacccttgtgctggggtgatacagtggttctaaacaattttcagtgtgatgtcaaggcatacaatttaattagagcacctaaaattgaattaatgaagagtttaaatacttgctataagtatgtagtatgacatctattaacaccatgtcccaatttcatgttttacattgagtggaaaacaaactgaggaaaagggatgagttcctcaatgtggagcaagagaacaatgtcaagccaggggatccactggttggcaaccaatggcataggtttgcttgatcttttagtgttcagtggtaccatcaactatatatatatatatatatatatatatatatatatatatatattttttttttttttttttttttttttttttttttttgcttccctcttccactgtaagtttaaaggagaacttgggctttggagtagttgtgctgattggtgtttacatactaactctgctgcttcttagctgtatggccttaggcaaataatttaacttctaagcctcagtttccccatctaaaaaataggggaactttacagggttattgtgagatgtgagatagaaggggtagagcacattgactggcataaaggaggggcttcataattagttctattgctttttcttaacactttcttctccagtgacattttgtgtcctttcattgctttttttttttcttctgtttgtattcccgtgtcattcactgatttattctcctagcattgcccaagacgaaaattgttgtcctctgatttagactagttatttcctctttaggcaaagaggaactgcactttaacatattaaggcatctttttctttcatttgcgcacaatgctgatttttgcagtcctattttacgccttaatgtgacaacttcctggtttttttttttttaaacccagaacttaactattacaacaaacctaggcaatttattttaattggcataaagagactgaataacaccagtaactgactgtggctttcatgtgaccctggtttgtgatgagctgtgctgtgttttgggaatagcattaatattttcttgcagtttgagtttaactatcaacggtttcctggcatcttttggttgatgtcagacagtaacattttagatatggcagcctgattgtcacctgcacatttagagacaattattagactagtggttttccttctaaagccaaagagttttttgataatcttcctatatatactgttacaccccccagttttgtgaacacacaataactagtcttatgacttgcggtaatgctgaataatacatctgttgtgttactttcctaatgtatgatctaagttgtattaccattgtcttatgttttccttaacattaaaacctttcttttgtttgtttaattttgtgtgtgtgtgttatggaatatactgttactaataaaaaattaaacaggaaacccacaggggacaaaaggatgtgtagatggttaagcttgatgtcacacatataaacaagagtatttatagcaaggtttatgtttaaaattgtgtttaaaatggataatttattaatgaacaggaaaataagtctaatttcttaattccacccaaagaaataaaaggttgatcctcttggattctaaaaaaaaagaaggtccatattctacctttttgcagttgattccagaagaaattggtttatagtgaatattcacagtacttgcaggtggtttggcctggaaaatctagatgagtggtttttaaatttagttgcttattagactcaagaaagaaatttaaaaaacaatactgattactgagaccagcttttctagattcttcattcagtaggagtaaggaaaggccaatgaatgtgtattgataaaaaggttcctggccgggtgcggtggctcacgcctgtaatcccagcactttgggaggccgaggcaggtggatcacctgaggtcaggagttcaagaccagcctggccaacatggtgaaaccccatctctactaaaaatagaaaaattagtcacgtgtggtggcaggggcctgtaatctcagctacttgggaggctgaggcaagagaattgctggaacctgggaggcagaggttgcagtgagccgaaatcatcacacctttgcactccagcctgggcgacaacagcgaggctctgtctcaaaaacaaaacaaaacaaaacaaaaaaggcttttaggttgagtctgattttgtttgtttgttttggtctcattttggagacagctttatgattagtgctgaagaagggaaaatgatcaacaggagagttgattgggaggctctctcctggggcacaagaaacaccatgtacttaaaaaatttttaatgtaaaatacccctttaaggatagaatttagggccttgaaattctactcagttgctatgaactgtggggaatttgagacaaatagcttttgtaattggaatgcacactgtgttgtaataatgtggaaagagaaacaaaaactttccttaatgtaatgagtttccattatctgcctaatctaaggtttgtaagtctacattgtcaggatttatattgaggagatagggggtgtcattttctgtacacattcctgtccccacaactttctcttcagcctcttctataacatcaaaatatttgttgtctgtacttttctttctccgcagtggttttcttatctccttttctgttggtcacactgaaaccacctccaataccacattgttaatggaaattcacacacttattaggtttttccttctgtagaacccttccaactcctcattgttcttaccaaagaaagaagatgaactgtgagattatttgaggccccccccctttttttctggtggaagtaagcaaagaacggaaagatctcacctttctatggataaagtaaaactccaacatgttatcgttttttaactgagttatttcataatgttgaaacatgaataataacaaaataattagattggttcttagagaagggattttaaaatataaaagctcattaaagcacttttcttgcttagtgtttaggtagaataagttcgctttaattccagtttgtgtcacttcctgtctctctctgaatagtaaaaaaaaaaaacaagaatgttctcacaaatgtgtgtctgccaacaaattaatactccacaaagagaaactctgccccacatggcagcttccaataaatgctctgattcaaatcacaactctttcattttttttttatccccttcccccttgagggagcacatttagacaatatttgaggatgtcatctttctgctttttaaaactctctagagttttcatttaagactcttaatggttgatgactaaaactacagatctggatagtggaaaaactaataatcttaaaaaacacttctgaaatgtggtaaagtgcattcattctcttccctcctctttgtccttttcaaagaaagaaagttcaatatgaaaccaatgcaaattatgactttactcagtgagatattttaccttctttcagactgtttcatactgaagtttataaaaaaaaaagaaaaataactatgttaaaataggagggttaaggaatgtattattcataagcataatgaacacaagaacctgtttttccagaagaattgggttgattaaatcattcaccacacaagcctctagttatttatttttgtctttagaattacagtacttagcttttataataaagtggacttgatacccatatttggtatggcagttgaaagtagtcaaatgaagaattatttcattttacaaaatttttagtaagtaaggaatataaacactatcagttaaacatagcaaacttgcatttttttattccttgggctatagtttgaaaaaaaaatcaaattattttatgtaacactgattcttacagagttcctttaagcgaagtatgaaagctgcagtgtaagctttattggcctataaatatgtcattatagttggactacatttatatgctttggattgttgtttaagccaagaaaatatgtctctacaggttgactttttattgaagccctttgaggcatacaacagaatgtattttaggccaaggttattaaaacagcattttcatttttttgcagcagactcattgtcaattatgctgccacaaactgtctgtggatgggcagttatgaatggtttcatctccaaatgtgtctttagaaaaagaaagaaaagatagaggagtctgagctgaaactgagaaaaaagacccaaagattatgtgtgggggtctggctgaatttaatgatgggggttccctcagttcaatttctgtttctaaatctgtcccatcaaattgagaaagagtagcttccccctttcttctgttgctgggactttcactgtactttttgggagtcaacagcatggtggggttaaaagagcagagggtgggctgtcaggagaatcttggctctacatgtagatctgtcaccactggaaaagtcactggaagacactgtatgattttttacctgagtgctctcatgaatttattaggatttgaagacatgcctcttattggaacaatccttccttcctttctagacttaaattttatgtgtatatattttttgttttttatttttttcagtgaagagaaataacttttattaatgagagcaatgaattcttaattctcagccacaaaaaaagataaaatacaatgagattttcaaatgtaaaataaaatatctgtactcacttcattgctgcagagataaagtgaaatattattatacagctctaaggtgacatgaaaagaacacaactgttcaaccaaatggctcaaagtaggtttaaattttatgtgtatattaaagagtctttggaaggtatttgttgtttatattttactttggattgctggtttcactctgccattttccataacactgcaacttgagaagtttcttaaatgatatattgtttatacattcagctttgttttgtctaaaatgggcaataatatgtacctggctgtttctcattggatttttgagaagaccacctgagaacaaattagttaatatctatggaaacatttgtgatactgaagtctaaagtggtattattagtacattattattatcagaagcaggttctgtatgatagggagccatgtggtacaaggttagcttatttgtcccttttgaatttccctaatcacacacacattctagtaatttagaacagggtttactctcattactgtctccctcgatagaaaactattataaaagtcctttaggtttttgcttgtttatatgtatatatataaatacatattatatatgactattattttaatatatatttatttcaaataataaatgtatgtaatatataccatataacataaacattttatatatttatatattaatatatatttatattttataaacttttatcctcctgaaaattctgtcaaaataaactgagccataagtggccagttgtataggatatctcaaatactcttggttaaaaattagctgtagtttttgcttggagattctggaggcctcgtattgcaaatggttgtttcagatcacttttgagtttgatatgtcaggcagcttcctgagatgtggacatgggaaggattctcactttttgttgaagaaaacaatataaatgtctgtaagaagcatgctaaatgcagacatcttgtcatagagacttttcactgctaatgaatttactaggattggaagacatccttcttactgggacaatccttccttcctttctagatttaaattttgtatgtatattaaagagtcttttgaaggtatttgttgcttggattgctggcctaagtctactatttttcttaacactgcaacttgagaagtttcttaaataatatattgttgcactatactattcatgaatatcatgaagaatcattacagagcaaccttctaactaaaacgaatttgggccaggcgcagtggctcacacctgtaatcccaaaactttgggaggccaaggcgggtggatcacaaggtcaggagttcaagatcagcctggacaacatagtgaagccccatctctactaaaaatataaaaattatccgggcatggtggcatgcgcctgtagtccgagctactcaggaggctgaggcaggagaactgcttgaacccaggaggaggaggttgtagtgagcagagatcacatcactgcaccccagcctgggcaacagagtgagactctgtctcaaaaaaaaataataataatttggcctttatagtatccttaagttcaacatggaaactaattacatacgagacttatcaaagacttgtaaagatactttccaaaggattttctctctgacaatattgttgtgttaaccatgcattcgttaaagaattttatcatagcccaattaacattggaggagatactctccaagtacccacatgactcttcaagagattgcctcatgccgttataatgtgacaacccaaaggacttttgatggagtacaagaatctgcatccaagatattcagagttttagaacagcttattaccagtatatcttctcacttactttctttttttttttttttttttttttttgagacagggtctcactgcattgcccaggctggagtgcagtggtgcgatcttggctcactgtaacgtctgcttcctgggttcaagcaattctcctgcctcagcctcccaagtagctgggattacaggtgcccgccaccatgcccagctaatttttgtattttttcagtagagacggggtttcacgatgttggccaggctggtcacagactcctaaactcaagtgatcacccgccttggcctcccaaagtgctgggattacaggtgtgagccactgtgtccaacccagtatgttttctaagaaactaggaatacatatggttataacacataggaataagattattcatttcatttgaaatttaaattttggcttgaccatctaattaaatagttgaatattgccttgtaatagtggtagaatgagtgagtaaaagtggctcaaataagtaatattcatttatgctgtctacactcagccatcttggctattcctgctagaaaagaggtctttgtgaaatctgaccaagtctgagccaatcaacagctggtcgttgataatgctgcccaggtacttgtactgccatcactcatgaaggcacaatccaagttaagaccctttcatttggaattactgttgacctgaggattttctagtgtttcctgcagccacgaaagcttcttagaattccaggttcatttcttcttctgatgacggactgaagatggaccatcagctgaaaagaagtttgtagaattttggaatttattcctacttttccatttggagatgtcagggcagaagtagaaaaaaagtgaaattggaactttctgtgctatttttagtatccaggctaccagtatttacctctaggatacaatgtatgcaaaaggagtaatggagtacaagaatctgcatcatgcttttctgaaactctttatagaattgtcaggctggaaggggccttcatgaacattgttttctcctctttttccttctaacagtcgtcaggcctctcttttcagttcttccctaagatgtgctttcagaatccctcaccatcacggttacttatcttaggatacactttaggtaattttttttttttttttttttgagatggagttttgctctgtcaccaggctggattcggatccctgcaacctctgcctcctgggttcaagcaatttccctgcctcagcctcccgagtagctgggactacaggtgcgcgccaccacatccggctaatttttttgtattttagtagagacggggcttcatcgtgttggccaggatggcctcgatctcctgacctcgtgatctgcccaccttggcctaccaaagtgctgggattacaggtgtgagccaccatgcccagctgaggtgatttttttataccatttaactcatttatattgcaggagctcatttttactaagaatcctagagccagaataggagtagattctagagaaaggccccagtgatccattacgcatggccagaactctaaggagctggcttggcatcctccagatacaacatgacattagcaaaactactggactcttctctagagctgtatggccttggcctttttataagtaagagcaaaaagggggaaaatattctgccactacactccctgaagtttaggtacctatttttttgtttgtttttatacacagtaatattaagtgtagactagtatctaatgaacatcgttgttaatatggcagctactgtggctcaatatcaatgttgtgccttttgagcttctgtagttcctgtagttttttactctagcatttaggatagggcttgcccaaactgatttttgcctcagtaacggtctacagttgaagaccagcttggtgtctgagagtctgtttaagctattccaaccaaataatataaaaactgcaagtctttcctaaattttcatatgtgatagtttaatcatgttgttctcttggacttaagctgttcttgtttttgttttgttttgtctattttttctagcagtttgtttttttacagccatatctatgataaaagaccatgatggaggctgggcacggtggctcacgcctataatcccaacactttgggaggccaaggcaggtggatcacttgaggtcaggagtttgagaccagcctgatcaacatggtaaaaccccgtttcctactaaaaatacaaaattagacgggtatggtagcacacatccataatcccagctacttgggaggctgaggcaggagaatcacttgaacccgggaggcggaggttgcagtgagtcaagattgtaccattgcactccagccttggcaacaagagcgaaactttgtccacaccacccccccacgcccccacaaaaaaagaccgtgatggataagacagtgaattcataattttgttttagcttcattaatttgaaatgttaatttcccaaagaactgtctgtagagattgccatctgatgagaagataatcaaaagatgaaagaataaattcatttatggtcctattccttgctatgcctttagtttcttgctgtgtaccttggattgactggaacaagtcttatgcggccttggcttcatacaagctcataaattttcattatcactgatagattgccaaacttagaccagtaattctgtttgcatttggtgataaaagtgggtctattgtgaaggacaaacccaactgatccaccatgttttgttctttttttttgagatggaggtttgctctgtcacccaggcaggagtgcagtggtgcgatctctgcagactgcaacctctgccttccgggttcaagtgattctcctgcctcagcctcccaagtagctgggattacagacatgtgccaccacgcccagctaatttttgtatttttagtagagacggggtttcaccatgttggccagggtgatcttgaactcctgacctcgtgatctgcccgcctcagcttcccaaagtgcttggattataggcgtgagccaccatgcctggcccggaccatcatggtcttttaaatatcttttgagaatgcaacactgactctgtacctcagatgtgcttttaaagtgaggtctgtctgggcacagtggctcacgcctataaccccaacactccggaaggccgaggtgggaggattgcttgaggccaggagttcaagaggaacctgggcaacatagtgagacctgtctctgcaaaaaaattttaaaaattagctgagtttggtgacgcccaactgtagccccagctactcaggaggctgaggcaggacaatcacttatgcccaggaattcaaggttgcagtgagctaagatgataccactacactccagcctgggcaacccacactgcattccagcctggccaacacagtgagaccctgtctccaaaaataaataaataaaataaaaatgaggcttgattcagcagttcccctttcagttggaggtgcatgatgcttttattttgtcataactctaaaatgtttttgtttgccttctacctctcacctcattagccactgtatgattactgacagtgagccattattacagctgctatcatgatagcatcaccttggaacacaaagcagatatatcctacatgtgaattgatgtggtttttccagtgggttctgtgagcaggtatctgatttgtgcatttactcttaatactcggtggtattgacactgattcttttgaacagtttgtttaatctgttagagtacttttaagtctgaagttctgttgcaacacattaactttcctaaatgtcagattcactcctctcctgtaacattatgtgtttaagtctgtagtttatgcaggtcactgcagaggaaagctgaggtttggacttttagcttattttaataaatgtatttatttaggacagactggaataatagtgggttttcaaagacttcgtgaagtgcttcatgcacagtaggggctgagcaaatagtgctgatgatttcaggcttttcctagttgcctcactgtgtgttttcatttggtgtgcttggatgaagtggtattgcttctttcttccctaaaaccccagagcctgtgccttgcctagaactctcttccgttgggcagccccacttgctttttgaatttttaactatttctattatcttttacttctgaccttaaatattggcattccgcttaggatccctgtttctttgcaaacttcatgcctacgggataaaatacaaatgttacaggagtatccagtgaacttccaggctccattttcttctctttttcattaagtaactttcattattgttattttttgttactaccaatgttatccatgtttgttttagaaaatataggcactactgacaaacaaaaagcagaaaaattaatgttgcctattttcctcccactcagaagtgctgttagtatttgtatatgtaccaatgcatatgaatgcatgtatcagtgagaatttatatggatattatttttcctcataaaaataaaatctactgtttgggaatctaccttcccatacttaattttgtacagaggtattataaatatgcccccatattgtaaaatatcctatactgggtttttttttcagctgctgaatatttcattacagaggtgtttcatactttaattatcgttgggcatttcagctctttctgattcccacaaactttataaaactcttgtagttatgcacatagccatgactatttctttatacatttgtagggggggatcgctggttcaaagtgcacacagaacgttaagacacctatcccctaccttatctcctctcctaaaccttctttgccctagcctaactagtctaactgcctggttttctttctctttaaccacatgtactcagtcccctgccttccaaactctccagtgtgttttaagtggctcatgcctctctactcgtggaatagcctttctaggagtcctacctgtgggaattctgcctttcgtttaagacttgtttaagcctctgaagcccttctcagccttccagctcagaggaattgccctgctttattgagctcttatcttatcacatttagtgtctctaccaccttattgatcaccttactctatacctaccaatataatgcagtatcttttttcatgtgtttatcttatcttcccaaaaagtcttaactctatagtgttagcactcagacatcaaagctatacctagtaggttaagtaaacatgcggcttttatgatcagactttcctgaaatctctggagttctctgttcttagtctacttgagacacctatgtgcatttgaaggttgatttgagttcttttagagcacttcctaagacactctctagtggagaggctgtttcattggtaccctgtagaagcagcagctacttggggtattagtttgctaactattcttggtctaattagtagtcatctattcatcactcattctagaaaacacattgagagatcacgtgaacatgcttgaagctatcctgctagcctgaggattgtaggtggtgttataggtgtgtgtgtgtgtgtgtgtgtgtgtggacattttacatcttaatagtggtacatattaatgcctttctcaagggaatcttcttcgtgtttcagggtcatagtagtgacaaaaatatgcagggaataaatccagattggacttgttccaccttacctttttttttattattatcggcttgtttgtaatctttttttaagatgacaggttattaagaagatgattgtagcacgacatctagtgctgcttattctaggcaatcacaccgttttaatcttcgcctcccttaaaatggttgcttgctaattatggtggaagatattctccatcttccaactactcattctacaacttttgttcacaaagaaagtattctgttaggccttacaaaaacaatgcttcatgcctggcctattctctcaataggaaataaaacattgttttcatagcagagctgataataaggcagagttcaaagcatgatgaaacatatacttttctagcagagaaaaacctatagttacctggctaattaactatcacgtgatggctgtgtgtataaagatacaggcttttcacatgtgcggcctgtatctgggtttcttttcttttttttttaattgagaatgctcatttagttcccattgatttgtattaatgttttccatcaaagatttagaagaatgagcaaacacagaagctgccattttagggtagcttctttttgaccactgtactaaacctcagtagtcagttatgttgtagcggaaagagcatgaactttacaaagtaagatggacctggattgaagtccttgctccataaactgtatggccttaaaagctttcactctgctttgattgcttatctataaatcagcgttaacaatacccatctcacagttttgtctcccaggacttgggaagattacgttagatcatctataggggtacccaacacacagtgggagcacttggtcaacaatattagtttcctttcccctttcctttagaaaggtaaacccttactcaagaaagcaaagtgagtagatgcaacataaaaagaataccaagacagagattacagtagtatgttatttcattttatttaattcacaaacacttgagttatctattataagacattgaaattgattgagggttaagtgagccatgatcccagttctgtaggaattttgaagtttttaatgtgatttttaaaaaatataaatttcagccgggcacggtggctcatgcctgtaatcccagcaatttggaaggctgaggtggtggatcacctgaggttgggagttctagaccagcctgaccaacatggagaaaccccgtatccactaaaaatacaaaattagccaggcatggtggcgcgtgcctgtaatcccagctactcgggaggctgaggcaggagaatcacttgaacctggggggtgggggttgcagtgagccaagattgcgccattgcactctagcctgggcaacaagagggaaactgcatctcaaaaaataaataaataaataaataaaaataaaataaaattatatatataaatttcgatgctaaaatttacctgtgtgtattgtcctacagacctgctttttacttcctctgatcactcttagatcatgattaacagctgatgctagttggctagaaaatttcgtgccaggaattcagaatgtactctggatgatcacatgtaaaacatgtgtattgctgagctcctctgatgtttctctggctgtgaactggtgttcttgtggtttattggatgtgcatgagtaggtgtgtgaatacgcttgtgtgtttgtgaaatcatcccaactggaaatctcttttgtccttgtggtatctatttattccataagaaagcaaactatgggccatgagcagtggcctgtaatcccagcacttcaaggcaggtggatcacctgaggtcaggagttggagaccagcctgaccaacatggagaaaacccatctctactaaatatataaaattagcttggcatggtggtgcatgcctgtaatcccagctacttgggaggctgaggcaggagaatcgcttgaacctgggaggcggaggtcatggtgagccaagatcgcgccattgcactccagcctgggcaacaagagcgaaactccatctcaaaaaaaaaaaaagcaatctatgatgtgccatggttttgtgtgtgttattttctcttggaggttatgagtaagaattttcaagtttagaatagcctaaaggatgctgtagtagcaacatttctaaaacctcaatagctgaacacaacaaagactgacttcttgtttatatactgttcagtgtggggtacataggactctaagagcagttttcccctctacagtggccctgctttggacctccataccaacacatgcttctatgctcacgcagaaagggaaaaaacaggcacaagtggagtactggcaattaagtgtttattaatacatacattaataacatgcagtaacatgcatcacttctcacatttcattaatcaatgaagtgattaatttcatgaccatgtcttgacttaaaggaggtggggatggatatatgatcttatagcattcttagaaggagaggggaattgaatgtgaacattagtgatatttcacacatgcatttaggataatgatgtatatcataggataataaaatctcagggatgaaaggaactacagataatctagttacaagattttagtaatgtcatctttactatacttactatctcttcaatgccctttgcagaaatctttttttgttttgttgttgttttttgagacaagctgtcactctgtcacccaggctggagtgcagtggcccaatctcagctcactgcaacctccggctcctgggttcaagtgattctcctgcctcagcctcttgagtagctgggattacaagcacctgccaccacgcccagctagtttttgtatttttagtagagacggggtttcgtcatgctggccaggctggtctcgaactcctgagctcaagtgatccacccgcctcagcctcccaaagtgctgggattataggcctgagccactgcaccaggcccagaaatcttgattagttgactttttaatattttcaatgagtgggaatttttattactttgtgagatagtcccattacatcttttatccatctctttgttagacattcttacttctgaaaaataaatttgactatatggtttataacaggggtccccaatccccgggctgtggactggtactagcccctggcctgttagaaactgggccgcacagcagaaagtgagtagcctgcctgaacattactgcctgagcttcacctcccatcaaatcagtagtggcattagattatcataggagcacaaaccctattgtgaactgtgcatgcacgtgatctaggttgtgtactccttgtgagaatgtaactaatgcctgatgatctgaggtggaacagtttcatcctgaaaccatcccacacagtccatggaaaaactgccttcgccaaaactggtccctagtgccaaaaagtttggggaccactggtttatagcataaacaattgtattaactgtatactgttgtttccagttctattcttataacaacatggcacaaatcacatttttctttttcttgatagcatttcaaatattttcatttcagtttccaggcctcctcagcactctctgtccccactcccaattttcccttctccaggtcaaacactaataacctcaatctcacattccttatacagtgtgatttctagttccttcacctttctggtggcccttatctaaagaaatctaagttgtccctatcactctcaaactgtaactacatttgtctgtatttaaagaaaaggtgacatctcaatctttctctccttaattttactttttatataacacacataaaaatgtaagtaaaaaatccttcttcacctcctttccagtcctactcctcctcccagaaataataaattgctaacaatttgcgggtattcctccagttatctgtgtgtgtttgtgtgtaaattggtttttgtttttttgaaataggatctcactctgttgggatcatggctcattgcagcctcaaccgcttccaggctcaagtgatcctcccacctcagccttttaaattgtttttctgaaaagacaggaacttactatgtgcattttagtgtttaacagtagtgcagagctctgctgtccagtatgatagctactagccacaaatagctattgggcatctgaaatgtggctactacagttgacaatttgggttttatatttaattttaactaatttcagtttaaaataaaaaactgaagcagtataaatttttttttgttaaacataactttattgtcttgtttttttgttgttgttgttgagacggagtttctctctgtcgcccaggctggagtgcagtggtgcgatctcggctcactgcaacctccgcctcccaggttcaaacaattctcctgcctcagcctattgagtagctgagactacaggtgcaaaccactatgcctggctgatttttgtatatttagtagagacagggtttcaccattttggccaggctggtctcgaactcgtggcctcaggtgatccacctgccttagcctcccacattgctgggattacaggcgcaagccactgcgcccggcctgtcttggcattttaactgtcatatatttagcatgcagactggatgtactggaagtgcaaaatacactggatttaaaaaacttagtatgaaaaagaatatatatctctctaatgatttttatatagatggcatgttgaaataatatttttgatatgttggattaaataaaatatattattgtaatttgaccttttaagaaattttaatgaaaatttaaaataatgtatgtgtctcactttatatttatattggacagtgctgatctagagagatttggacaaatgcagtgtttagcccaatctgttattttgaagtagaatcaccatttcatgcttcataaggccagggcactatatttgctgtagaaagaatatgaagacgaaagggacccagtcactgccctcaactacggccttcattttgaggttgtccacctggttggttggtgggtttcctcttttagattggagggtttctggttttcatgcatgtgtaggaaggaaggaactcacaggtagcagggcaaacagctacaactatgttataaggtagagtctagccagtgcatggatgaaggcgtaagcagtgttccaggagcttggatgaaggttgcatgagtacgtcttgcctgtgaacaacattgtaaaaacttaaaagagtaggcattgtgacctctttttctttctttctttctttttgagacggattcttgtggattggtgtgatctcagcccactgcaacctccgcctcccaggttcaagcaatttttatcctcagcctcgcaaatagctgtgattacaggtgcccgccaccgcgcccggctaatttttgtatttttagtagagacgggtttcaccatcttggccaggctggtctagatctcctgaccttgtgatccacctgcctcagccttccaaagtgctgggattagaggtgtgagccgccgcgcccggccgtgacctctttttcattggtagtagtctcatacacatgattgttgaatgaatgaggagactcccatcccatgtactactcttcctattctaccaggatattactagaaataaagaatcttgtggtcagctctgacttagattttctttttgaaaggcctagtcatcccactaggaacttatacttagttcaaacccagctttccaaatagaaaccctgtgcttgatgttaaatactgacctttttgttgtctccgataagtgcatagtggttcattttgaggttgtctggttaacagaagaaatatgtatattgtatattccttgtcaaaattcctaatattccaccaaagctctagcacttccatccagaaagtgttctgaggagttgaaggctctttcttattttgatttattcagtttcatttgcttcataattatgaagactgtccaggcctacaaatggctgcattggcaatgaaaggctgtcagttgaagctcagaatgttaataatttatcctctcattcactatccatgattcatcactgcaatattttcatattatattcttagggtacaacctacaagctaggggaaaacattagcaattttagattgcaaatgatagaacctttccatgaaaatgtcaactttttgcctagttatattcatggttgcaaatggggctagtgtggttaatcaaattgtttcatataaaacaatttctcctgaaggcaatgttagtggtggatttcacaaaatcacagaattcaccttgggagaactttgtggctgaataaaacttctgtcacatctctgtctggggagtgaaggtagggcaattttatctagaatctgtactacacctaataggttcagtgtttggcaggagatatactgataatcattattcccccaccccaccttcaaaaaaacctataaattgggctacatgtcaagtgcctaaatgttctgctgggaaataacctgagtaataggatcttaattaagaactgatggataatttttgtggagatgctaccccctgccaaaatctgcatgcagaattttatatgtaaacacacattttcttgggagaccattcatagcattcatctgattctgaaaggtattgatgatgattttaaaggttatgatatacccttttaaatgcccaattaccagttactgttctccccaagaagccactcaggcatctcagctaagttttatttactgtattttcctaatagttcatgcacgtgtgatagggaggacaggtggttggtcacctagtctagtggggctataacttgggagggcagcatggatgactttgagaatccaaagaaccctatggactgtctacccagaaaacgtttacatccacaaaatttgaatgacatttgaggacactcatgaacagccccctcctgaagttggtccatgaactccttgttaaggactgctggatgatttcctttaagaacacagaaccattatgctgtgaagaaggaaaacaaggatgatgtgtgtctacccgcttggttggtgggtttcctctttcagattggagggtttcttttttcatgaatgtgtaggaaggaagggcatgactgtcttatttcatatatttttcttttatattttcaaattataaattttgacaacaggagacaataggtaatattcattctctactgtctggacagcatggaaatactacgtacagtaatgtcttcagtagttactttctctttagaaagctccaaggaagctcacaacagtaggaagtcctactgaaactccttttggtaaagtggagcacgttttgtaatggaaacacattttctatggcttaatttttatatatagggttttcataaaatgagacttgcctaaggattcttttggaagccttttgcctcttttaacagcaatgtgtttattataggaatcagtctcctgctcacttataaaatattctaaatattcacttataaatattctaaatatttataagattatgagttttgtcttttaagtagggagttctgcatattgtttttggccaaaatgtagcctgcctccttgagcatgagttgaagcccaagatgagaagcccttttttttcccctctgaccaagatctcatctgccatttactagattaggctacttgaagggaaggaaatgagggcccccttcttttaatccaggacattgttaggtatatcataggtgctccgtaggtatgttggatgaatggatggatgattagaccttaaatcttgtacttggcagcaacataatgtagtggtaagggactaaaagtctggcagacatagactagcactctggatccccaatctctagctttatgcccttcggcaagttgtagagtatcagttttctcatctgtaaaatgggtataataaatctatctgatagggatactgtaggatttaataacatatagaatcccaggtgcttatggacatttttctggtgccataaagcacttgatacatggtagcattattaaactcttaagccttaaatcaggatatcctagactttagtcatttataaagcaactttatagttcttgccataccaataacactgttttattatttacttaatttttctttaaattaattgctttttaatttaaagaactttaagtaggaaattttatatcatcactgtaaatggaaaacctgtatcacttgctataattaatggtgaaggtaaatatataatccttaaaataaaaaatatgtttatccatgtaccacctaacattgacttgggtaccgctagtgtataccacagttaagtcatttcctttgaggcttttctcttgggcaacagcctaacctaggttatcgatagctttgagaccttctgagaccatgcaagcctcgtgtcaacaacaagctagaaagggttggaaccggttgcgctgaattaatctataggctcagaagtgtaactgccacacagatgtgaagtctgaaaataacccaccgtgcacctgcccttttcgcgtgtcagttacagtgttaactgagcaccagaggatgaaatgctgtaggaacagtaaaggcatgaatcttaccttccagatgctcagactcttatcagtggtttgatacctagccccttgattgggcttggggacctcagtgtctcaattctgggcaatttctttctttctttctttcttttttttctgagatggagtttcactcttgttgctcaagctggagtgcaatggtgcaatctcggctcactgcaacctctgcctccccggttcaagtgattctcctgcctcagcctcccaagtagctgggattacaggcactcaccaccacacctgaataattttttgtatttttagtagaaacagggtttcaccgtgttagccaggctggtgtcaaactcctgacctcaggtgatccgccagcctaggcctcccaaagtgctgggattacaggcgtgagccatcgcacccggccttctcggcaatttctgaatacagatcttagcagggtgagggaaacggtaattgttattactaccaactggccccaaacagttattgcataacgttgcacaactgagtcctgggtaaaatgagcttcttcagaaattgcctcgccaaaggtgatttgccaaggttgaatccttcggattgtctgcattggaacaacccccttgcccaagcactgagcttaagctagataaaaggaaataaacactgctttaaaagggagtgcactttagcagcacacaaaaaacaaaggtgaaggctcacatctgtgttgcattgcataattgataaaagctgaagcaccattagaaacagcctcatcatccatactcctctcctaatcatttaaatatgtacagcatgttttaggatgcttgttaatgactctacgggcacgttggtagtcagaacattacatgtgggtttgagaaataggcctggatcatttgccagacaatctaattctgacagtgtagtgaaggccatcttcaatttgactgtgctccactctgttatgctgtgaaagaaaaagataattcagctgagcattctgccgttggctagaaacaccgcagttctgaatacaaatattatgcaggtaaatgaatcattaaaagaatagaggcataaaatatctgacagatgaactcctaaagtttggactagaataaattttcccatatatgagcagtaccttcatccatcgactaacagtgttagttatccgttaagtcaccaaaaagcatttatggtcttagagtaaatgattggtaattatgacttacaaggctataaatacatggaggggatttggtgatatcataataaaccacgaaagaaactgcagtggtttttaatgttagtagaaacttaagaaatatttagagccgtgttcgcagccctacagttgttttttttcttttttctgggagtgtgtgattggtgttttgtcaaaatgtgcaactctaccaatggactcaactcaactaatgtaaattagggccaatgagagtgtccgactgagattagtcctcaatttgtatgacatgtgtctcaacaaatagaaaatattcttaaagaaaaataagatattcccgcatgtctctcttttttagttccctaatttctgattcctttcttctgaatgagttttctgtaagttaaaaaagacaacagtgaaaggccctgttcctctcagcttcttaaccccagtttgcctggtttatctcctgttttagattctaaaaaggaaaacattaatcatgcttagccctggactttgtttccctacctgttacctcctggtctaatggcagagatactgaaaggggcacagacccacaccagccaactgacctagctcatagccacaggaagagcggcatgtccctggggcagtgagagcgagactgcacccagaaccactgtctcatgacaccaccccacatctcaattgaagatccagatggacagctgacctatatgtctctccctgactggaccagctcggcagagcatcctagatttgagtaaagagcaacacaattctttgtaaagccattggccccacagaaagctccatggaaaatgatacatgagggtgttagtgggaggttgagaactgcttggtgcattcttgatttctgtgcctgtgtcctgatttcaggagacttcggtcatctttgattactgtcattactctagccccttctgtgtgcagttactatagttgtacctagtgtgttcaaggcaccggggaagaaatgacctgtgcccccagtgtacctacagccttggcatcattagcaactctcagttaaaggagcttaacacagagacagatgtgcctggtgtgaaaaacattgccaggatctgccccagagtgattttatttttgcaggtttctgtggtcctcaaatcccttttagatttgcacctttcttgattttgaagtctggggtcaaatatagagatcaacttgctggataatcagatgtagtggggagagaatcaacacattagcaactgtagggaataggcaggcatcagtctaaatggacacaaacctcagggccacgatagcagccagggacctcttgtgtgtgtcaggagttaacccttcagtgtctggactatagggtgtccaggaactcccaagggaagaccagagatagggaggaagagtcagggagcactagggagaggagatggggcagcagctatttattaacctgcagggacgtctctcagtattttaaactgatgaggccattctagtgcgttctagcccttgctgcagtcctggtgtcagtgtgttaacccaggggcaggaatctgtctagtttctgtttgtagcttactgaaatcccaccctataatgcttaactgaatagtgctcttcaaaatgcaccaactaaaaatagtttcatctgcagtgtgaacatagtttcatatttatactagcatctggcctaaggaattgaatactccattctttaaatagcttcactccagctctggaatactctgagaagaaaatctcccccaatcaaacaccttgtttacataggcatgcttaaatgcaaacaagctccctttttaaaatgcagaagaatattaatttgtgaggcaatggtgctttggggtagttttttggtgagtgaaagtaaaggggttaagtagagaatgaattttttaaatgtctacttagtaaaagatttctgagatgcctattatgttttaaatttttcattttcctaaatttgattcaagaacacattaattgtacgtgtgaattcggaattccttctttaccatcacatgtgaagccagttagaatgaagttcttgggaagaaaaatttatgctgccgctaatgcccaacaataatagaaatataagcctagatatactttaactttttctaccagcaaatgctttggggccggaaatcatttgccagcatgcaatgaatgtacttttgttagtcttagggggatactaatggttagtccccatgaagaaaaatgtgaaaataacacacaaaaaggtaaacattgcgaatggatggctaatgattagctgttacagtccaaaggggcagggtattttttttatagttttatgacccttggcccagcctttattgaaagaacattgtatgttcagagttatatatttcaaacgtacatctcctttgaatatccctctttaaagataataggaaatttttccatgttcatttttatttgtagagagaggaggattttaaatgtatactagttttaactctgtattaaagaggaggaacggttatttttaaacatcccattcatgaacccacagagtaagatataataatatacctttaccctccacccaccccagccatcctgaaaatgagtgaatgtagggcagtatgattactctgtcatgtagatgagttagtattcggtacattactaccacagtatagttatgatatgtccctctctgaagtgaatggtttttgtgcatatacgtcaattcagaaaaaaaatttttttctatttaaaataaaaatggcttttttgagttcccaagggttctatttttacaacttgcaagaactactttagtaaataaaagaatgtcagtagaacactggccactaaaatgttaacatatgggtatatttgaggagtagtaacataaaggcaacttttcagtcattgatgttaaaattagatttgaggccataatctcaaagaggtaggccaggggttgtttttcatggtctacgaaaataaatgctttggttgaactaaagttatgtgcattatctgggaaacaatgaaatgtcttaatttagacatcactttcatttttcaccagtgggacttttctagatgaaaatctaatcctgttctaaatcatccttttaaaatgtttttccccattacaaatgtaatatgtttgtgttgcagaaagtaaagatatgcaaaaagaagagataaaaatcagccatagtcccactatgcagaggcttaccactgttaatggtttaattccaatttactatattttctttttactaagatgtcactggttgtatacaatgcgtcattgatttcacaacagcttttggggaacaggaaaccatttcatcctaaatatatgcatgattttaagatatatactgatttcagaaagttaaaaagtggtgaggagaggcagggagcacgttttaaaattagtttttaaaagccagctctggccctcctcccccaagaagtcatctttctccctgtgtttccagctcacagtgaatgctctccctagtccaagactcctagaattgtaaggaattgcaaaaattcaatctaattttatttgcatccatcacagtaattttcccatcgttctctcagtgatattgagattacttgccttacacaactgtagattttttttttcacatgctctgaattttagaaaattctttgtttttacatggaccaaataccctggctttaccacattttcccgttgagactagttcccttaaggcaccccataagatgagggtataaactcttatcccacatgaaagtccttcagatactttaaaagcagtaatctgttgctttcaagagctcctgaaatcttcctggttcttctgacatctcctaatttctaggtgaaacatccctggtgctttcaacctggagtattccttaaagtgcacctttgtcatgtgcttcagttaatcaatgcccatttaaaaatactgcctgcagaccatatatgttgtgtaaccaatgtggcatattataagatctataacattttttatcctggacctatatttccatgaattctgcccgcattttattatttctcactagcagtactctgtatattggctcgtatagaaataatggttagctcagaaaaccgggcctttttttcccccagaacgtatgtaagattgcattttccgttactagatttagcattaatactatctttaggccattttttagccctttaagagcattttgctcttcactcacatacatttggattatatcttccaatggtgtcatctgcaagtttgagaaggcttctataactttactcaagcagctgattaaaacaagcaaacaccaaacaaatatgaaccactcttatttggatgttaccatatttctactttaagatatatcttcctaacttgactccaacctagtgtcttacaggaagaagcttatcttaccggtcaatatttgtattatccagagctcttagttcaaagtaaatttttaattgatccattggccgttagtgaatcatatatctaccttacttatcttcagccaccaccacaattctttgtgtgtgaacacaggggaaatatgtggtatgagacaacacatcgaacctggctggcgatggtttgttcacacagtgtcatgcaccctacagcaaaaaagttcttttcttgcatccatatgctttgttgtagaatgacaagtggagctggttgatggctaaatgtgcatctttcagctagatgatttgtactgtgtagacaaactgcccaaacattcaatttttccctttccaagcagatgttttgctagaatgtagacacagcctccaaaaatacctttctggcctgtgaatgttaatgtctctcttatgtgtgtgccatttacaacagaaaatataatgctggcattttatttcaacagaatgttggaagtacagatcgatgttgtaaaggtaagttgtccaggcccatggaacagttcatataaccttttggtttggaaatgcttgtcgcattcttgtagataaccatctatttgtacattcttatttttcttggtttattcagtaaacacgtaagggcctattatgcccaggctccattaagccttggatttttagaaaaattattgaaaatgcgcattttcttattgtacggcaagtgggtgggggtggctcatttcatgaaaattacctaagtaagaatttataggtctataaacacacctaatctagtgtgccacaataataatacatttaacatggcaagtcagcacacacacacatatttatacacacacacacacacacacacacacaaacacagtttcaccaggcagtacttaccccttaccgacaatgccctctgacattttcttttctattatatcctatttcatttttttaaaaacccacccgattggttttataatcctattaatgggctacaaacctacagtttagaaaatactaacatacacataatcgtttttgcctgatgtctctttctggttaagcacactatttccaaacttaactaagtgtttatggatccaaattcggctaattgatacttaggttcttccaaccctgtaacaatccctgcagaatttgcatttcttttccaaagtctaaaaatgaaccctttcaaggtatcctatttctaaggcaccattactggtacagttccgtgctctttttggtaatctaatatattgtcatatgttactaaactacccatgtctaaaacagaagaaccccacagcacaagtccatttatgatacagtgcccttgatttttcaaaatatgtggataggtttgctgttcttctcatatacagtgtgttttaggaatccatcttttaggcattgtctgaatcagcgtattactccttgatagagaaagagtgataattcctgctttttgcccaggacctaagagaaactgctttcaacaatcccaaagacaaagaaaagcttctatttataggctccatatggtttctaaagttttaaccaaagtgaatagaacaataataaattgctttcacatttctgcccatagaattgtttatttagcattttctgtaaaacaagaggccttccatccacatgaaaagactgtattttgattgcctgggagattcaaaatgatttctaatcttgccacaactgtcttctgctgtataaatgaaatgtttcattttcaaagagactgtcaggatattctgaaaagagttccttagctgctctgcaataccctcccccccaaataaagtgctttgttttgtattttccaagagaacaatggcattacttctcatattggaagatacgattttcagcaagtcctaaaatgcttatttgctagcagtttgtttcatcaggttcctcataggaatatcttatttaattcacttacaaccaaaaattcccagttttgtgaggtggtcaaacaggatagtagccttctgcatatggaaaaggaattgaacctataatatgcattatgcacactgttatccttttttttttcagagtcatggtaataagtgtctacaacaaaattcccttccttcattgaaatagacaggtctttgctcgacagctggacagaccataccagccataccaagggacctggcattttgtgaaggtgctgaggaggactgagttgagtttaccaaatcagccttcttgacccttcggcttagcattttcaagtcattgacattctcttatacctgtgccgctgatctctagacctgccatgagtgtgaaagaggcttcgttttttagtgacactttacccaaccaattttcactcaagaatcttcatattctattgtctcacaatcagaataaattggcattttcctcactcagtctactaggtgctttaattgtgtttagaaatagccttttgattcttttggatttgttttttgccctaagagtcttgatttccgtactaaattacctgacaaaactcactctctccaacatcaattaaagggatttaaaaaatataattacacttaaaacactagaaagagtcaagtttttagcatatgttatggcttgccagtacgagaaaagtgacttaacatccaaataaagaaaaatagttagccaatccattcattatgttgatatgatcaggtctccaagatgcatttaatcaatatattctgccttgattagccatattgaaatacttgaaaacataacctacaatatgaaaatcagacatacttataaatgccaatagcttttatttagagtcaacaagtgatgaaaaagctcttacttaaataaattgactttgagaacaagaatgcgaacagaaacataattcgttcattgtataattgtttttccctgctgtggacattagcctttggcatatggtctttgaccataatctatgggtagatatagccagggcactggaggaacacgaaggtgaattccagttgggtaacactggagaattccagttaaaacaaggttgactaaaatctaaaatacactgtaacatagacaaaagaattcttattgtagattaaatgtatgtagaagatatagaaggattattgtgtctgtttcagatgtaatttcatgcctgagaatttacattgaaggaaaaatggtctggatcccattagcgaaggccctgttttgctgtcagtttaattaaatggaaactgctggcaagagcgccgaggaggttgatagaagcaatgctattttgtatgttggaacaggaaactgttaggtcttccagtttgaaaaggatacaaaaatgaaacctgtgattcatttttgtttacaaactccttcctagtttacaatgaccttagtgataaattaactaaaataagttatacatagtgagcaggacaatagcttgatcccaagatatgaaatactaatctctgatgaagaaggtagaacttatttttatgtgactttccccctaaacaatggattcctcaacaaaagtaattgtttcctttggtttatttttctgtaagtagattgagaaaaggaggaggggtattagtttgcttttaaagtgtgtgtgtgtgtgtgtgtatgtgtgtataaaacaaaagaaagagaataaaaaagaaagaaaagggaaaaagagtaaaatagagaccctgaaacagtgatttatctgttaagtgtatttggcatcctgccttttggctggaatttttgagagaaacatatttggtttactttaatgggcaaaagctctgaacctcatttgtaggaaaaaaagtgcatgttttcttttccctttttcagttcagtttattatatcttgacattctgtcttgtaattgaatagtaattctggatttagagtggagaagaaagaaatttaagtcagtcctcctcccctccttatgtttcagagaaaaggactagctgatcccaaagttttaacttttttcacagccaccctttgaactggcaccaaaaaaatgattgtttaattttgctgaaactctgtagctgtctttgttccttgactatgctgagggttgttgatatgtttgtgtctattctaataatgcaaagtcagtatgtgttatccgatggaaattttcgatctcagttaaggaaacagattggcagtgaaagtactctattagatattgccatggtggatacatgacattttgcatttggcgaagcctgtagaactgcacaatacagaaaatgaaccttcatgtaaactgtagtcattattataataatgcatcaatattgtttcgccagttttaacaaaggtaccacactaatatattaaatttttaaatgttttgtgtgaagatactagcaggaaaaaaagatgtcagtggcatgtaaacctaaattgaattttttcctaacttggtgcagctattttatcattatttttaattgaatatatattggattgtcatcttcttgctcgttgtgttgagggggatttatcagagttacaaaaacatgaaagtttggtatatttatttcaaaaaggcatgagcaagtatttgagccatccaacgctgaagaacttatatgaggttattttctttctctatgtccacgtttttcataatctcttttaattgtgcttattttgttataataaaaacaatccatgtttatcataagacaatacaaagaaacagaaagaaaaaaattatccagaataccaccatactgagataactagtgttgatatttgcctgttattctatattttttatctgcttatatgttggatattaatttttaacattatactgtatctctagtcttatatcatgctttttttttttttttttttgagacagagtttcgctcttgtaatccaggctggagtgcagtggtgccatctcagctcactgcaacctccgcctcccaggttcaagggattctcctgcctcagcctcctgagtagctgggattgcaggtgcccaccaccacatccggctaattttttgtatttttagtagagatggggtttcaccatgttggccaggctggtctcaaactcctgacctcaggtgatccacctgcctcggcctcccaaagtgctgggattacagccatgagccaccactcccggcctgtatcatgctttcaaaaacacttaatatgctctttcacacagtaaatattcatctgtagcatcatttttagtgatgaactccactgtattctattatggaagtgccatagcttatctgactatccccctattgctggactttgggttttttcctccagcttttgtatataataaacagtgctctcagagacatccctgaagtcatattattatttctttaggataaactcctagaagtggagcttgtcagatcaaagttcaaagcagaattctcagacttttcctaggtgctggtcaaactgtaaaaaacattttcggtagaattaggatcttgtgtatattgaaaatccctcaatgattgcatttgctacagccagtgtgaaatgaacaaatttattatcaagtttcatgagaagttgggcaaacttagatatagccaatcttggacagacttgtactttctgtgcagaacatgtttctatatccagaattctatctccagctctcagactatgatgaggaaagacaacccaacactaagagagctcctgatcattccctcctctacctatgagaaccatccacaatgagcctctgagggcctatatttgtatcaaggcttccagttgaagagacatacccagtgccctttagaatgttctgggtctatgctgtttgtatgtggcgggggaggggaaaaagggtggtgacgttcttttccagtctctgctcttacaggggaatagaggaacctcattagaaaactagcaaagtgatgggctgagaccctctgtgaaagggttaacccaaaaggttttgtagccaatgagcatttatcctgatgatgtcacaatgctgatatcaggggctccagggctctggggagttcattatgaaatcactcagaactggaaacattcattccactatttgtggcttttttgataaacaaggataaattgaagttttaatagactggggctacatttgttgctccaggttcctgaagatcattatttttagtcatacttaaattcacacacacatgcatacacacacacacacacaccagatgccagtgtaaaaaatgggaggggggaagcttttaatctttattattgattttctgtgtgtacaattttatctaaagagtatggtttaccagccattgtggagctaggctttaatgccaataaaaagctttgcttgatccttagaaaataaaatgagatattcaggcagctagtttattttatttcttttcttttccacatcaagacagtatttcaaataattaggttgatttattattacaaatagtttgaagatgtaagatgcttttacagtgcagtgcgggtttattgtatctggccttatccaattataaaatcgagtttagtcatgtaatgattctctaactaaaatatcaatcacagtgaatggacttttgcgatgtatatactgtgaggctattttgagcttctctctttaaggcacccgcacatctgaatatgcttacttggctttactctttaacatataagaacacatgaaactttggctaaatttagcctctggagtccaatgcacatgcttggtgacagcaaagggagaggttttgacaacaagcaggatatgatacaccagagtaattatttccgcaagacaatgagcattctacattatttgtacaaataacgcaaagtgattatttggctgtgccattgtaatgagacaatgaagatcatatttaattttaaaacaatatcttctagggtcttttttgttctgagtattctggactactaaaacaaacttgatttgctgctatggttaacaatcacattttaagtgggggacagagagaaagagagagaggagaacaaatctttccccctcttcccattaactctagcattccagaaatcatgataagggtatgtgggacaggaatgttgaaataagtcacttatttcactatttttccatattgttcacataaccatttatttataataatttgagtaatctcagagttcctcctaaaggctttttttggcctggataaaaagtacagctttaagatatttctcctaaaataaatttgagacggtctcatttatagtcagcagtgccttgattacttgcagacacactggaaatttacatgcgcttttctcctttataaaacactgatctgttcatatcattagttccctcatgactagtgcttggctgcttgccaagcggtctaaatctgtagttgtaaatcgtgagttgaaatagcagaaagtggatttgtaacttaaaaagtgtaaacagtttggaaaatgaagtaattttggagtatgattgattgccttgtgattgtactttaaattagcctggggtctcgggggcagatatgtgctctaactgcttattacacattttcagttttcgaaggaataatagcattgttggtaggcttttaaacaatgtatgcatctcctggagtgaccttttaggaaatgaatagttttattgtgtgtccattactttgcctgaaacaacatttttgagttattaatttgacttgttctataaataaagaattcaaaatgcaaagcagctgtgcaacccagagcatagtatatcatgcttcagaaccactgtttgagatggataatccatagaacaaatggtttcttgggtgatacattaataatgtttctggagcctctggttaccaaagattagcccctcaatattgcagaagccaaaaattattattaaggaggacaatcgattagttggccttccaacacactggaagtagaggtctgcgttttttaaaaggatcccagttcacttaacagcataaatagaaagtgggagtagctcagtgggtaatgtctgcacaaagtgtagcagttgtgacagaggagaaagacttggagttagaaagcctgaggccagatgtctttttctctcatttaccagctgagtcatcctagacaagtcactgagtctccgatcctcttttttttttggctaccagtaaactgggtataagaattccaaccctgcaaaattgttgtgagattgaaattatttaaaagatttgaaaagggttttataagtattaaatggtctatattgcatgagtaccatcattattattagaactattgtcattgcattactcttacactgtctttggtgactttgcctgtctattaatattgagaatagctgatggatgtaaattctgagcaatagtcttattcactctttgctttcatagggagcgatctagaaataatttttgtatattaataatagaattctagtttttgagtatggaaacaattttccaattatagctatttctttgtatttattacttcttccttgtctaattcagcattttggggggaatcacattttgtttccatgtttagagaggaagaatctcagttccttaagcatttattagagcttttaatacatgtcagacagggcctgggttaagcactaggaatacagtggtggaaggaatgtagtctttgcctttataaatgtccatgccttcaggcatactttgccaatagaatgctcttcaatgatggaaatattttgtatctctgttctgtgtccagtaaggtaccactggctacacatggctgttgaccacttgaaatgtggctaatatgactgagaaactgaatttttagtgtataaaatttattttgttctaattaatttaactttatattgccgcatgcagctataatggcaaaaactgcagttacttttgcaactacataacagaagctattctattggataatccagctccagagtaaatggctttaattgccagtttggaaggtaaagtggggtatttcatagacacgtggaagcctaaataactgtgtatatttgctccctaatgaagcacaatgccaaggctcaggaaattggtgtttggatagtaccaatggaaaaaagcagatggattgctttttagagtgtatgctgttgaaacatcgaagtggtacatactgatggggaaaatgaataaaattctcaaacagtgcctaaccttggtgagcgggcaaagatggtggtgccgctgaaactctgccagcgggagaatgttcattgagtcagtggaaggtggtttggagcatcaacacccaatagacatatttgcaagatttacaaatgttgaactacagaataagtgactctctgccacacaggatcttaaattacgtagcacttcacagttccattttgagttatccaaattcatttgtgtttgtgggagagaaactttctttcttttttttttttttattatactttaagttctagggtacatgtgcacaatgtgcaggtttgttacatatgtatacatgtgccatgttggtgtgctgcacccattaactcatcatttacattaggtgtatctcctaatgctatccctctcccctcccctcaccccacaacaggccccggtgtgtcatgttccacttcctgtgtccaagtgttctcattgttcaattcccacctatgagtgagaacatgcggtgtttggtttttgtccttgcaatagtttgctgagaatggtggtttccaacttcatctatgtccctacaaagacatgaactcatccttttttatggctgcatagtattccatggtgtatatgtgccaccttttctttatccagtctatcattgatggacatttgggttggttccaagtctttgctattgtgaatagtgctgcaataaacatacgtgtgtatgtgtctttacagcagcatgatttataatcctttgggtatgtacccagtaatgggatggctgggtcaaatggtatttctagttctagattcttgaggaatcaccacactgtcttctacaatggttgagctagtttacagtcccaccaacagtgtaaaagtgtttctatttctccacatcctctccagcacctgttgtttcctgactttttaatgattgccattctaactggtgtgagatggtatctcattgtggttttgatttgcatttctctgatggccagtgatgctgagcattttttcatgtgtctgttggctgtacaaatgtcttcttttgagaagtgtctgttcatatcctttgcccactttttgatggggttgtttgtttttttccttgtaaatttgtttgagttctttgtagattctggatattagccctttgtcagatgagtaggttgcaaaaattctctcccattctgtaggttgcctgttcactctgatggtagtttcttttgctgtgcagaaactctttagtttaattagatcgcatttgtcaatttaggcttttgttgccattgcttttggtgttttagacatgaagtccttgcccatgcctgtgtcctgaatggtattgcctaggttttcttctagggtttttatggttttaggtctaacatgtaagtctttaatccatcttgaattaatttttgtataagctgtaaggaagggatccagtttcagctttctacatatggctggccagttttcccagcaccatttattaaatagggaatcctttccccattccttgtttttgtcaggtttgtcaaagatcagatggttgtagatgtgtggtattatttctgagggctctgttcggttccattggtctatatctctgttttggtaccagtaccatgctgttttggttactgtagccttgtagtatagtttgaagtcaggtagcgtgatgcctccagctttgttcttttggctttgaattgacttggccatgcaggctcttttttggttccatgtgaactttaaagtagttttttccaattctgtgaagaaggtcattggtagcttgatgagaatggcattgaatctataaattaccttgggcagtatggccattttcacgatattgattcttcctacccatgagcatggaatgttcttccatttgtttgtgtcctcttttatttcgttgagcagtggcttgtagttctccttgaagaggtccttcacatcccttgtaagttgtattcctaggtattttattctctttgaagcaattgtgaatgggagttcactcatgatttggctctctgtttgtctgttattggtatataagaatgcttgtgatttttgcacattgattttgtatcctgagacttcgctgaagttgcttatcagcttaaggggattttgggctgagacgatggggttttctaaatatacaatcatgtcatctgcaaacggggacaatttgacttcctcttttcctaactgaaaaccctttatttctttctcctgcctgattgccctggccagaacttccaacactatgttgaataggagtggtgagagagggcatccctgtcttgtgccagttttcaaaaggaatgcttccagtttttgtccgttcagtatgatattggctgtgggtttgtcataaatatctcttattattttgagatacctgtgggacagaaacttccaaaggtactgagtgtgagatgcagccagccacgacacagagctcatcgggagaattccacgggagacccgagtacacatggcctgccagtgggaggtgctgcacccaaacctctgcagcactggacagtgatgcatttttgcaagccatctgagttcctcaaagtcctttcttaggtcctacattagtgagtttcctctgggagaggaagcaacttttggcattgtggaacagttatttaaatacttgtggcaaagaagaaaagtctaatattagagcaggaacagagactttagacatcatggaatccaatcttgtttttgttttttaaattccgtgttcctggtgagccatgtagatcgtaggaaggatttcacagagtcgatgggagaactggaggagggcttggtttacatccacactccatgcaaacactaacgtcatcactcccagccaacacttctccccatgactcttcaactggttcccaattggaggtcttttctccaggcgtctcccacgtggaggccccttttgcagaacaccactgccaggaccactgcccttccaaatgtccttccccagctccaagtccttagcaaaccaggggtctaccctctatccaggtctggcacaaacagtagccacagcaaccacagtgattagggcccatagtacttttaaggacccacaaaaatgcctttagtccttttaaaacgagaagaaaacacgatgacctcttcagtcgaaaaatatgttttaggccgagcgtggtggctcacgcctgtaatcccagcactttgggaggccaaggtaggcgtatcacctgaggtcaggagttcgagatcagcctggctaacatggtgaaaccccgtttctactgaaaatacaaaaaattagccaagcgtggtggcacatgcctgtaatcccagttactcaggaggctgaggcaggagaatcacttgaacccgggaggcaggggttgccgtgagccaggatcatgccattgcattccagcatgggcaacaagagcgagactctgtctcaaaaaaataaaacagaaaaatatgttttaatacattatttatatatttatctgtgtaccaatgtagtcctaaaatgtgacttttaatcttttcctatggaggaaggggctcaggagggcaaagtgcctagaggctaatggaagccacaggcagtgctgtctttacctggtcacagtctccctagaagacagtgactctgtcattttacagagccagagaatgaagcccttctttgcccatggttacaaatccagtgcctgtttcatatttctcctccttatgctgcctcttcataaggcatcgccttgatttcttcttaaaacgatttattctggggctgatttttcccaaccttaatgtaattgtactttaatcaataaaaaatttcctgtggaacaactgggaggggtggggaggagagaagcccagcaaatgtgaattgttgtttatttgtctctcttaaacaatgtttcacgttaaaccagttgcaaatgaaatgaattgtattataaccatcttggaaaaatagctgctgatctcataaattcatcgagcttcctggttccaaagccctctcttacaataatagtaagtgttgctgtgctcagtaaatatctgcctccacttggctggtagtgaaggaactagaatggcaaacccaagatgggccccccttctgcctcctccaaaatcacaggttttgtgctgaccctgaacaggaatggagaggaacatggcttcccaggacagtgactactgtcctgtctcctaggatgccagtatcccaaatatcatcactcacccagtaggttgctcctctgggcacctccactgccttgcgtctgttctcagtgctgcttccgtggcatctgcctttgtgtcatcggttcatctgggcacaggcctctctcagaacttataagcagtggctatgactgtgggctttggaatcagacagacctgggttccagagtcaccttgaacaggttgcttaatctctctaagcctcaatttcctcatctataaaatggaagcagtaaacttatccctcataggattgctacagtgatgaaatacacatcaagggcttagagcttgcctgtctgtagtgcatgttcaatcaaaggcagctgtattctagcaggacagtgcaataactgaacactcttggtgggtagcctgagttttgttttgtttgtttgtttggagacagagtcttgctctgtcacccaggctggagtgcagtggcgcactttccactcaccgcaatctctgcctcccgggttcaagcgattctcctgcctcaccctcccaagtagctgggattacaggagcataccaccacacccaattaatttttatatttttaatagagacagggttttgctatgttggccaggctggtctcaaactcctgacctcaagtgatccacccgactcagcctcccaaagtgctgggattataggcatgagtcaccatgcctggcctgaggtttttatcttttttttccctgtagtttggcattaaatgtcataatgactgtggtgttaataaacatcaggaagtgtgcttggcagtttgcaaactggaccttatcttacctgttcaggtgtgtgagatcttctcagagatggaacaagttcctcaagtttatgatctcaaaacccacaatgtctgttcctcaatgcaggtctcttaacacctgtctgttacattatgttggtcatccaaggatgcattaagcagaaaagaaacacctcacctaggtgttactaaattccattatcctcctgtcagacgtccatggtgggagagactttggtccccaccaacctgggtttctgcagggtttcactacctgcctttttatagagtcttgtataagacaaatggcattttaagctgtttttctttttgcaggtttggaaatcttatttaaatcaatgtaatgagacactttgaacaaaatgtaatcattctcacttctccacgtgttggaagaagcagtatagagttggagacttggggttagattagagctggctgtcttcacagatttgcatccttgccgtgtgctctgagttgtcacagtgtatcagataggtgggatgtttttgcctctgtgctaagtaaattacattctagaagaattaagagggctgttatttcatggtgattttttaaaaaaagtcagacaccccagaaccgagctagaattgttggaccagttttcttcccttttcttcttggcctccttcttgtcaagaacaactgttctccagttttcaagaaggctctgttgaagtggaaacataagcctccattaaagtataagggtttgcgaggaggtcaagggagtcattactttgtcttttacaacaaggatgtatttatatattctgagttaaaaaaaatgcttttaaagaaggtgtgagcaaagataaaaattatttcttacagctaaagaaaagtagtctcttcatcgttatccatgagggaataactcattgacacttataaaagagcgtcctagcccaagatatcatgtggtgggaaatttgattggaagaatctcttccactaacttgtgcatgagaatatttgttccagctccaaagccttagaagctgttagagaaaggtgggagggtatttggctggccttgggaaatggtaacctaacactggaagccccttgcttttgttctccttattgtacataagaagatgagattttatttccagatttcaaaacacggaccaacttgcaataagaaataaacccccgccaaggtgatgaattatgttgctttttaatttagaaactggccctccgatcagaaagagtaaggatgactttaaataaccagattgatttgcaggttggggcaaagtagagggatctggtggatctcagagactctttcttggctgcctagaacctcatattgaggctccttcagaggctgcttgtgtgagcctctgactaaatccttaaaataactgctgttggaagtcctgtaagtttcaaaatttgttactggagcaaggaaagggtgtgttgggtgtctcactcggcttgaagtaaggacctgaaagcttagcagccaataaaaagagaattaggggaagatgaatattaattttaggaaatacaaacctcagttttctcatccaagcccttcctttcctcctcctcccatttagaattgaagaattgcaatggctttgacttaaaaggataagaaagagtagtgattttcttaaatcggaggagacaaacatggaatttttataaaatgtaatatttgctggtatttaagtatactttggtggtatcttggctggcgttcagagactgttgaaatcatcttgattgtgaaaagtcgctaaatggagctgttaaattgtgcttcgcaaattacatttagctgcaaagtattggttcagtctaggcctcctgaatgataacacctattatatagatgttctctgtccacatcccacctgaggaaaaaaaaatcacatcaggtttgaagttcagttgaggcaaattttatattagtaatatcgttcattattgagagagatctcggctgctgacctgcgtatgaagcacttgccccatggaagttgtggcaagccaagtgccagaaaaaaaaaaaatgaaaaaggaaatatttaaatggtagactatgtacttgatgtatccatttttcttctgcatgaacccagtcataatccaaattatattttttaaacccccttttgttctttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgccccttttgttcttactgttgtaccaaccatagcttttaaaatctcagactcagagatgaaatacagaacatctttttcagagctgggacataaacaccttcaaagtgctgagctctgggatgtgctttacgttttaattattcatcccctgggctccactgtttctttgggagccaccaactcctccttggtctggagtctcatctgttttctccatcaatggaggataggactgggagctccctgagagcaggtgctgtcatgttcacccatgtaaacccactgctgaacacagcatttggcactgagtaggaaccaaataaaggttcgctgactgcatgaggaaagcatagacattatccttgcatatctacataaggagacttaggttactcttcctgggatcttgccctcagatgctgcttgcatggtctctttctcccttgaagagacttcatctggacattgaacgtggtcttccttgaactggggccagtggagcttgctcatgtggaggcagcaggtggggggggcctcagtcagctgagtgaaaggaggaagatgaaggctaaggtttaggtacaacaatcctccaatatatcctccactcttgctggaatggagagtaggcccatcactaccatgcatgagcgcagcctcgctgccttcaggatttaatagaaaacccatagcattgccaccaaggttctctcagagttccaaacccgtatttcagacacagcacctaaattccagagtcctcactggttcataccagttacagccctggggacaggagattctcctctctccttctgaccttttgaggcagcaggggcaggcagacccacacattgggcccagatctattctccaggcctccttagctgtgtgactgttgttaaattacttaatctctttttggcatcagtttgcccatctgaaaaatggggctcataataacttccttagggctgcccaaaggaggagagagaatgttcatgactgacaggctggaaagattaatgagtcatggtattttaatctgcctggggagtttctatgtatccttcaaaagttagcttgaggggtttctcttccctgcgaagactttcttcactctctttgctaccaagattctgcctctgctgtgactcttgtcagaacacttacttgtattaggttggtgcaaaagtaattgcggtttttgcaatcctgtttaatgacaaaaaccgcaattactttttgcaccaacttaatacatctgttcacatgcccaccaccttttctaggctatacacccctctttaaagagggatggtggcttttggtctttatcctcttgccacctgctacttcttaatccacagaaggtattcccttggtgtctgaccagccaatagatggaagaccattttgatgttaaatcctttttttttaaccacatattatgttaatccatttatatgaaatgtccagaataggcaagtctatacagacagaaagtagatgagtagttgccagggtgttaatgggtatgaggtttccttttggggtgatgaaaatgttctaaattgattggagtgatggttgcattgtgagtgtcctaaaaaacattaaattacatatatgtaatcgtatcatttttaatcttatctttttgaggatacaatgggtgcaattgtgtgagctacgtgtgtatgatgagaatcaggtggttgtggatctttgtcccgggatcaaaagaggagaagtaatagagagaaataataataccattgtcttcacttaggctgaaatgtgctttctaaggggttaaaagtaaagaattgtgctggcgaggtgtgttctgtgcaatggtcatctgtttttgagattatcttccaaataaggcaacaccaagcttcacttagggattgttttgaacacaagactggaagagattctttaatactgcaatctgaaaccagaaatttgcgtctcataaaaatcacgagaattctcaaagccaccagcccactggagggtctctgagaggtacctgggaataccatgaatctgacagggctcttctcagaggttcagagtcaagcagaaggcagctggggtgtgttgagaacagtgtgagatttaaaatagtgccaggcaacttgcccctgccattagctggatgaccttgggcaagtcattcacctcattgagctgcctgtgtcctcctgtataaaatgggactattcttgacagaccctaagagagattctaggaggattgaatgaatctaagcacatgaaagggctttataaatttgggagtgttatacagatgagtgattataccatgcataataaactatttgtaattatacagtgttaagctggctgtgtgtgctgagaaggagagctgaagggagcagggcaattgctgtaatcaacattcgggtgtgttatgtccccaaaatgtgatcagggaaacactaacttgttgaggtgagccatgaatgacaaaaaagtgggggagggtgaggaagcggatgggagaggatttcatggtaaaataaagtcagaaaaagcagcatcttcccccctgtgcattaaaatgtccattagcatgttaaaggctccaagctgtttgtgtaactttttgttaaactcagtgtttcccgtgctgtggtgccccttttccacataacccttggtaacatactcccttctttctcaaggaactagtgttccttggcatactttggaaaacagcttgcaaagcaataatcagacaagtacctacggggcgttcactgtgtgctacattagcctgactactttgcatcttttaactactgttaaagaccccccaggaagtcactgttcttaagtccattttacagtttgggaacccaaggcttaacaaaaggaaccaaaggaagactatagagatggggttagggtgaaaagaaccatgaagacatctgggcactagtaagaagcaagaggaagacatagtgctacctggtgaaagctgccgtcagggtggagctgtggccttggccagagctgccaggccaaagcagagatggggcagagaagaaatatgacaacttctcactctttcccacatgcgatctgttaggtgtctcccattggctgaacaagcagaagccagccagcccatgagggagcccaatgatacaacattcaggggtcacagagcaaggaagaaagaatgggtaatagatccgggagtaggatgagaacagagggacagtgaataaccagaaaaagaaccaacattaattaaaaatctatcatgtgcttcgcttgtttccagggtgttaggaattcagacatgctacagacctagctcctgcccttcaaagaacccatattctggaaaggagagtccagcttgaacaagtaaatgcagccaagtgttacagagtaactgtatcttagaaattaagctgatattcgtgatccaaaatagcagatttctggcagcaagactatattctctagatcaagggtcagcagagccagatagtaaatattttagatttgtgcaccataaggtctctgaggcaaatgcaccactctataatcacacaactgtgccgtcgtagtgtaaaagcagccaaagacaatatgtaaatgaatgtgcatgactatgttgtaataaaactttatttacaaaaacaggtgttgggctgaatttggcccatagtttgccaaccctttcaaacagaaataaccttaaagaaatatctgagagatacccagaaacagggatctgtagcactggtaactcatggtatgaaaccacagaactatcactggaattaatatagtagtcacgagcaatttgtttattgtcttttatgagaaaagagaggtaggtttggatgttagagattggggaaaaggggatatttgctgtggaaatgattttcagcagatggtaggtactttgggaaaggtggctaaactagagccatcctcctcctgtcttacatcagcttactcagtactaaccctgtacaaaaaggaagtaaaacagagcacatctgtatcatcagctttcaatgatgttcttccatggtgcactgtgacagcacattagaaggtgccggagtttttatatgactgctttgccgtgagattaaatagtggtttcagtttccagtaggtttcataagtatctctttcagctgttaaattacttttagtaatgtgcacactagaaaaagaaagaaagaaatatccattctgaacaactgggtgtcatgacagaaaacagagcagatggttttgtggacatggcaccaagtgaacctgtagctggttacagcagaaggatatgtttaacccagaggagagggctctcaccaggtcttaacagttgaagcttttaagagattattattttactttgaattgatttttgttattcaccagaaaccaaaggtggcaagcgagaatctctactaaaataactatacttgctaactttgggtctttgttggggctttggggtatcagaacaatgaaataacaggcactgtgaggcttttcctcctgttctgttctcctctcctagctatatttcagaacatcttatctcaagatagttggccaaaaggaacctgtacacagaacaacctcatttttcccaagtgcctcttcggacccaggacacaatgattttaaaatttcttttcaggcagacgctctaaagagagctatgctgttcaataaggtagccactagccacctgtgacaactaagcccttgcaatgtgtcttgtccacttcaagagatgctataaatgtaaaatacacactatattttgagagcttactatgaaaaaataatgtaaatatgtcactagtaatctttttttttcttttactttttttttttttttttgagtcttgcactgtcgcccaggctggagtgcaatggtgcaatctcggctcaccgcaacctctgcctcctgggtttaagtgattctcctgcctcagcctcccaagtagctgggactacaggcatgtgccaccatgcctggctaattttttgtatttttagtagagacggggtttcgctgtattagccaggatggtctcgatctcctgatctcaagatccgcccacctcagcctcccaaagtgctgggattacaggcgtgagccaccgtgtgcggccagtaatcacttctattgatcacatgttaaaataatattttggatatactgggttagataaaatagcttactaaagttaatttcacctgttttctgtttacattttcaatgtgttaattacaagttggctcacattgtgtttctattgaataatgctgctctaaaagatttttgaaaaaaataatccatgtattcctttgcccagttttaagtggacatctacatttttaatcatgttttgaataaattttgtgttaataagtaaaaaatgttaaacatgataggaaatgaaataagatggtgattaactataattagaagacatattacatatgatttgataaaaatctgaagtttaaatctgtgtttaataaagcacaacagttctaaaataaattatctaaaatttttatgcataggtttatgcagtttatgtcaaaaaatctggtagccttgccgtgcattccagctacactttaatggatcagcatcgttaacctttattagtttggcttttctgaatttagagcatcataacacaggccaaagtactctatttctaatgctaagcttcctcttgaacagaactatgtgcaaaaagggaaagatcaaaaggctatggcttgaggttccttgatagatcaataaggaagcatctccaaaaccaatactttgatttgactctttagtgctcataataggactagggatggaggatgggtgaagaaggagatgggctgttctgattgctggctcattcttgggcagatgcattagggagtggagtagtatctaagttgaagatctgccccatccctatgtaggttccctttaaaaagtcttctcgtaccctcaaaggagagattcaccattttgaagaccactgatttaagatgagtcactgacagaggcaagaggccttttcccttctttccttgttgagctgccccagaagccctgcggtaaggtgaaggaaaacaatgcaacctataaaagtgctcttgacacagatgttagctcccagaagtcagtgcagttgcagaggtggctcagcacttagagcatggtggacaaactcctcaagtggcgagattattttattttttaaagtcactaaaatgagatgactgcctaaccacatgaccctttgtctaaaaaaggcctgccaggcagtggctacagtcatgttgggcagataaccttctccagattccttcagccttttaggaagtgtcattggttcagagcctgtggtgaactaatgaaatgactgctcttatcctttggaagaaggctcagatgtttactgcaacactgtctgtaggcaattacatttgtcagcactctcaaaggtctaggagggataccaaagaattaggacaccgattctgtgccctccaggatatattctagttgtggattggagagacaccacttttcctccccagagcaaccaagcatgcatctacacagaaaatataacccttcccagatgttcccctctttgtcattgttgtgtaaaatagacataacataaaatttattattttaaccatttttaagtgcacaattcagtggcattaagtacattcacaatattgtgtaactgtcaccactatctatttctagaactttttcaccattcctaacaaaaactttgtatgcattaagcaatagctctccattccttccaaccctcctagaccccctgcacctagcaacttctattctattttctgtctctatgagtcaccctgttttgtgattccacttttaaatacctcgtataagtggaatcacaatatttatcctgtacacacacacacacacacacacacacacacaccaaattttgttatctgttcatctattgaggaactattgggttgtttctaccttttggctattttgtgataatgctacaatcaacattggtatgtaaataactgtttttgagtccttgtttttaattctttggagtatatacctaggagtggaattatcacatggcaattctgtatataaatttttaaggaagtcccatactttttcatcatggctgcaccattttacattcccaccaacaatgcacaggggttcctatttctccacatccttgccaacacttgggatttttttcttttcatttttataatagtcatcctactgggtgtgaagtaatatctcactgtggttttgctttacatttccctaatgaagagcattttttaagatgccatttatatatattctttggagaatcatcaaagtcctttgccatttttaaattggtttgtctttttgttactgagttgcaggagttctttatgtattctagttattaatcccttatcaggtatatgctttgcaaatattttccccctctccaagactgtcttttcactttattgatagtgtccattgatgcacaaaagcttttaattttgatgaagtccagttgtctattgtttgttgttttcttatgtgcttttggtattatggttaaaaaatcattgtggaggccaggcacggtggctcacgcctgtaatcccagcactttgggaggctgaggtgggcggatcacctgaagtcgggagttcgagaccagcttaaataccatggagaaaccctgtctctactaaaaatacaaaaaaattagctgggtgtggtggcgcatacctgtaatcccagctactggggaggctgaggtaggagaatcgcttgaacccaggaggtggaggttgcggtgagctgagatcacgctatggcactccagcctgggcaacaatagcgaaactctgtctcaaaaaaaaaaaaagtgaatggctgactctagccaaagtttaacccatgtgacggggaagcaagttaaggtaagtcaggccccatagaataacacctcatatgtggtaacaactttacctacatgtcaatctggccatgaagtctcacctgttgcataatccctgtctagtgtgacatttaaatttaaatgtggctaagatgaaccctatggcaataagctgcaaaattctcaagataaaaagtggctcccggtcgtggcttagaattcagtgaccctttgggacaaccttggaggtggagttggctttcttcccactgcgttcatttgttactcagagtggtagcagtgtttggttatagtttagttttgtgatgttttttttcttgagtgatgaagcaatagtgagggcaaaagctgatagtaacattttgatacatatttttgtatttgtctatgcctctattttaagtggtttgcttttgaaaacagctggttcaaacccttggttttgggtttgaaatattctttgttttgtttgcatccatgtactgatatatttttcccacatttacttttttttaagttctccagtgatgttttcgttgcctatcctgggaagatctgtgtttccatttagcaaaacaaatggcaagctggggaccatttaaagtagtttttttttagttaataaagccaagccaatctccttgttctgttatgttaaaagtacattatctttttattgccagttctgtatggctagttctgttttctgtctcagcaatctcagggctgccccacttgcttactgtgtcgagaattacaaaatcattaagggtggggcagcaccagctgacttacagtacaaaccatttctcaaaataaccacaacagtgcaatactgatgtgtaatttacgtcacagtttgtttttatgaaatagtttgtggcattttcatttctattccggatggaatcttgttctctttcccttttaatcaggcatttaatttatttttattattaatattttccactccttgttttggcatgcctccaatttaacagctttgatgaggaagggagatacacacacacacacacacacacacacacacgcacacacaactgatcttccctgactccaactcttcaacatcagtttaactgcaaatgtgttttcccctttgatgtgtactaactttgggtactaagtttactaccttaagagagattgaaaaatacggcaggacacagtacacatttacatagagctataaccacgaattgataaagttgatgtacaactttggaattttaaacactttcaaccaattcaagctatttagtcatatgctctgctgcattttccttttacaaatgtctttctgtataatgtcctgtaattagaacaggaaatcattgagtaactgcaagatgaataagagcacttagactgaaaggaaaattaccttccgagaaattatattctctttttttttcttcatgttacaatgttggtaatgatagtaacagctgtagctactcttatctgtagaattttcatgcttaggttttctggaataaaaatttcattttcagtaataataaaaaatgcatggacagaaaataggaaatgcctaattgtgacaaatattcggtgtcacaacagagcagcaattaaatggaaacttcaatataattgtcaatagcagtaagaattggaatagcgccaggtatataaagttgatgctttgccgttggttggttgctaggagcacagtgaaaagtataaagctttgagaaaagaatgtctaatgtaataaagtaacaggaggaagcataaatcattgtgagaacctcacatattgacattattttgcttaaattgtttcaaaactagacatcaagctttataacgtgagcacattcatatttcctttaaaaaaaaaaggagaaagaaaactgtatgttgtctttgaagcacaagggacattgtgtctcaaacttagccttcatacatatttggaatcttttaagtgaaaatctttaaatgtttgtttctattggcatccaaatgcatttgccctaatacgattaagagaactaaagggcaaaatacttggcagatttttcagttgaggtaattaggtgcaggaaggaacatgcatattttttccactaggctctataaaatcctggggcgaaggtttttttttaaaagattttttttaaaaaacttactgatgttagaagtagattatagtggttttcagtaagcataatagtgtgatgtttccgaaacaagcctcccctcaccccaagaatgaaaaagaaagttacatttctaaattgttgtgtaagagataaaagcaaatttctcctctggaatttatgttttcagcctccgtgcatttggccgccattatctattttcaaaaaatagcattatggatatttgaaagtcaatgctccattaattcattgtgtttgctatttcatgcatctctctttgtacaaagacaacttgagcaacctgctattcagaatgaaggcctgctcttaccctttctccccgactccttccccacccccagcccaactctgaggattaaagcaatggtatacagttactgtttgaaaagcttgggtggagtctcatgttataattacagtttcgctatggaattctgtttcggactttgaaatatataaataagtaaaaaattgacattgagagaggttaacaaaacgtgtaattaagagtcattttggttgagcattacaagcagtgtactttaggtattaacttttaataggcaaagttctttttattgaagttgaaatgaggtttagtaatgttgggtctcttattccctttgaatgtttcattttaaaataggcattcacttttttttggtataggagaaattcaggaatgggatgacattttaatagaatatcataattatggtttaaaatttcagtcttggttactagcaatttattacagatcattttctgttgactgaagtcaagtaacgtatatgtaacccaaccagctacaaccaactagagtgtgttagaagaatactcctaggggtactttgatttctttttctctatgggtgtggttgaaagaaaatctgtgttccaggaacactttgtttgtcttttacaaaacaaatgtgcaatttattcattcttagatttatctgctttccctattatgaattggaagggtgaaaatatcttacacagcatttattggcagcccttgtttcatgggtaactttgcacaggagtgtttacttatgtgtatatgaaatgcgtgggcaagaaagaagtagccgaggaatttaaataattcttgaaaggactatttggctttatttgtttcctggtgtactagggcaaaataaaatatgccgaccattgaacactttagtatttttatagctgtatcagaaggaagttaatttaatgcaaaggcttaggaggcagttttaggatcacagaattttagatctggaaatctctccccaaactcaaaattttatactctgttatacacacctttcatataaagttgaccatattttgtcttgaggaaaaaaaaaaatgttttcaccaataaaataaactgcaaagaagagacctggacccagactgttttactcagtgaaacttcaacctagcttcaaccttggcttttccaggtcccactttgactctgtatctttcccttttacttttcacttagaatgctttgtaaactttcctaggagtcctcaaggtctcgtgggctttctccagtttggtaaatattaaaggcaactcctctggggatgtctaattgcaaggttggaaatctgcctctgtccaaacaatgccaaaattctggtccaaacgggaggttctgttcataagcaacaaagttatcatttgtgttttgccccaccaagcattgccacaatagaccaagccccagctgtgcctgtagcctcttagtgtgtggaaggaggttgatgaaaggtaggggttctaggctggcaacacatagagttgggactatttcctatcacatgcatagaaagtagaaagttaatgtacatgaatgatgtatcaataatgttaaatcattacagtggaaattgcagtgttccaaaataataagtaacaagctaacctaaggagagtagaattctggcttccaactggctgaattctacagtcttacatcaaacagaagtcttatatttgacttgatcaaaggccaccatcctcgtccctaatagtgtaaaccagttaaatctctgttattattattactattattatttgagacattttatcctaatgaaaagtccaccaaactgggagttcaaagattgggttataagtcccagctactcaggaggcagaggtaggaggattgcttgggcccaggagttttgggtccagcctgaagaacagagagaggcccatctcttaaagaaaaaaaaggattgggtggttatagtctcaaattggggaatattaacaactagtaatgccactaataaggttgttgtgaggaacaaaagagacgtgaaaacactatataaaaaacctttgtgaattttagtgttttattatcagtactggaaatagcattaatacttgctttctaaatggggaaacagtctctctgtttctcgtatttttagttaagagggcttttaaaatttgctgtcttctgtgatatctgtaacaatcctgcaaaagtggcagagagaagagattttgcttctttgttctatgtactggggggttaggagagaaataagaattttttaaaagtctgacaactgaaaaaaaaaaatatatatatatatatatttcaaaatccaaactaacaaccttactttaagtcttcgcaaaaaagtaaactcagagttactggtttcaaagtttagtgtgcatgagctatttgggatgcttgttgaaaaggtaaattcctagaccccagccttagagatgctgagtcactggttctcgatggcacagtatctgattctgatgcagacagtcccaggaccactattagcaacactgtctccaggatgcacggacagttgtaggagttgagagtagggggaacttgctgtttttcttccaacagaaagagaaggattcatgacttggctagtgttttgggtactgcgtgatctaaatgttttgaactaggatgaggtggagagaaaaaaaaaagaggtcatttctaggcacagaagattgccagggagccgactccatccagaacagagaattgggaagcagttagagatggcatcatcatgaaaaatggttagagaaaaaaaaaaggagaatgaagggatatgaaggaagtgaagtggtcccaagagtccaggtgacatcttccatgaaacttactctgaagcaactgttcatttatactccttcaacctgagagcacacacatttttctccattttatttcaagaatacttggagaaattgatgcacctttacccctatcatagaaagctaattgcacaaccaagatagaattttagaatcaacaggtatttacaggcacagtatttactatgtatgggagatggtgttaagtgctatgaggggtagtcctggcacttaatggttatatgcctctctctcattaacaatgtcttagacaaatcgagtataatacaaatcgagtgtaataatacaattgacacattgggggctgcttcttgaaatagcacttaaaaactctggagaaacgaccgcatttgaatattttcactaaaactttttgtgctttagctgtataaaaagcacggttttgaacccaaagtttgaacttagcgtcttggtctgctgtaaaaatctcagatgggcatgccttgggacatatatcagcatctcaaaactagtttgcattgggggacttgccttcaaggtaaacatatttccttttaattaagtgtgccagctgacaaagcagctatacacagaccaggcaggagttgaagacgtgtacactgttaaaagatgtcatcttgtaagcagctaaacatctccatccgtggaaaagccgccagcctgaggaactaagtgaacataattagaaatacatctgggtattggcctcctatctgaaaaggtcacatgcacaccttccattggtactggttatgttccatcattatgttccgtccttgctcattcgtctcccactggttaccagatggccatgataatgtcggtatccttaacaactgtctagtgcaattccctgcagcatggtaagggcttgaaatattgagtgttttccctttggagaagcaagtgacatgtctgggaattgcttacaaccgctctgatggggtggttgcggagtgatggcaaactgggtcatggagcctaaattcagcttgatgttgtacaggtggaggccaccaaagcacggtgtttgccatttctcaagcttaagatgaaggaaggcttcatccatgcagaatctggtgtttacaaatgagcacaaaataaagtgaggtgtaaataagcattaagatcattataagaggaagcttcgctaaatttgctgaaatgttcccctgagttaaggtggttttgatagaactctctcacaagaatgcttagggagtcctcccagcatggttctctgaggtgtgccaagttaccagatggatttgaggaacgttaaaagagaggagtatgggtatggggagggtggagaaggtgggtgtatcaatcaagttgggctagatcatgctgcaataacaaatgacccccaaatcaccactgctttagaacaacaaaggtttattttctgcttatgttatatgtctcttttggatcaaccaggggttctgcttcatgttaattttactccaagacccagactggcagagttgccactatcctgggacattatagatggtcacagcaaagacaaagagagattgtggtcagtggtacactgggtcttaaagcaaccatccacttctgtcatatttcattggccaaggaaagtcacaaggccactggcctccaagagagtgaggcacacaggctttccacaggcccaaaaggagaacaggaaatagttgctgaacagcactcatgaccccagagcagatggcgatgcattttagacccatggacatctttggggccagatgaccttttcagaggctccaagcactgaaaagattatacagatgcttgttgactttctatggggttacagcccaacaaaccaattgtaagctgaaaatatcaagtcgaaaaggcattgaatacacctaacctactgaacacatagctttcctagcctaccttaaacgggcttgtaacatttgccatagcctacagttgggcaaaatcatctggcaacacagtacactgtagagtaccggtgttcaccctcttggtctcgtggctgactgggagctgccacccactgcccctgccaagccttacaggagagtgtcctactgcatatcaccagcccaggaaaagatgaaaattcaaaattcaaagtatgctttctactgaatgcatgttgcttttgtacgtggaaccatcgttcagttgaggatcatctgtataatccaatataagagcaattccaaactagaaataaatgtaaagaagcccagcaaagttctacctttccctatgatgaggatgactttaatgcttcaaaaaatgaagattctttcaaaacagtttttgggtcctactgcttgctgatgacacaaacattacttactgtgtctagagggccagcctactcttttcttttctctgcaagaaggtccactgtgcgggtagcctgaagcgtattctgtggggctggatgggtgaagtggggctgggaggatgctggcatcccccagactgtaacaaggatgagagtctttttagtcccaaaccagaagtgattattgaaattataccatggccatgaaagttctttgtcagagggaagagggtaatggaagtgttttctcgtttgtctaggggaggacgaggaagaaacgaacgtgatagttctcagctacccccagtactgccggtaccgctcgatgctgaaacgcatccaggataagccatcttccattctaacggaccagtttgcattggccctggggggcattgcagtggtcagcaggaaccctcagatcctgtactgtcgggacacctttgaccacccgactctcatagaaaacgagagtatatgcgatgagtttggtgagtctttttttttttttcctacctgattcttgtgcgtgtgtgcctagttgttttcagttcttctgaagagcggtgatggggaacggggctcactttcacaagccccatgtgctgccccacccctcccatcccccaaattattgcggcataaggcgtcattgcctccttcgtagcctctgtttactatgagtaagagatgattatttataatttgttgttcaatgtagagtctgaagttgcttggtcgaccttgaaattggactttaggacaggaagctttcatgttacttttctctcaaaaggctttgtctattcaaatgcttttttatttaactagtcactctcttttcattgttataaggtattgtaaaaatgcaccaatggtaaccacttcagtagtaaacagtgaatagataaatagatagaaagaaaacaacttcagtactgtatggtggataaatagataaccactttagtactgtacagtagatagacacgtagagagatgatagatagatagatagatagatagatagatagatagatagatgataggtgatagatatccatgtcctgaattttttcatacactcatacacacacatgcacacgtacacgcacattgtgcccaccaaagatggatacatatcttaatctgcatctctgcctagctaactggtcacgtgtctctacatgtagacagaaggggaggagaagaagatatcacatcaccagtttgggaagccttacacggtgcagtagatggcgagatgcaagccaagatagtcgttctcttacattatcactttctcatctgtttgttgaggagactggatcatatcagtggttttcagcaggctgggcagggatgtcagaataccctggggtagccttatcaaactgcttgtgttcctgggaatttctatacttagaggcgtgaacccctaccactctcaccctaccccttctctggaatcactaccacagagtgactgctgggatggctgagccctgctgaatccctcatggctacctgggtgaagaagaggttgagacccttagcctggagagagcatagggtccctttgaactgaaacattccttgattttgttggctgatgttttcctgagaatcactagttggcagattatccagattcaggttactctgcttatcctttgcagaccttggtatggtttcaggagtccactatggcctcttaaatttgattcttcatgattccaacagccctggtgctgctactagagaaattttgcaagtagctatgtgaacagagttggggtgaggatgaggagatggcatatgatgatcaagaaggaagggaagacagagagaggaaggggaaccaaatgatctaagtccattagattctaagagccatgacattttttccctctaaattgtgtttttggatatctctcacaactctggcttatcaaatgactgtcattctgtaagagggcaacactgtttgtatttattttttcttcttcaaagaaatttatttattgtcatatttttagtattcaaatatcctttgacttcaagtagataaatgtatgcaatacatttttttacaatgccctctcttttcagatcagcatttacaaatcttcccttttcaatacctgtgtttgagtttttcttccacattctcggctcccaaacgttgcttcctacttgccgctcaagaggtctctaaattcctgacacagaataaaactgaaagcatgtgttccctcatttaagagtgttcaaaattagagtttcacaacgtaatatgaggaaaaaaatgttttaacctttctggttaatttaagaattattagtcattgagtttcaaagctgttggatctagaattggtaatagaaagaagttccaatttaacagcgatcacaatggttgttaagagttactaaattagttttaaatgttctcacaaaaacaagcatctgacttttgaatgttttcctgaactttcttctggtatagctaattttaatgctgtttttcttctccagcctcttaaagtggaagctttcttttggaataaaggtacctttagagaccttctagatggctagtttaataattagagtattagacattttttagttgtttgtacttcaaatagtttgtacttcttacagactttcatgttagtaagtggaccaaaaagcttattttgagcagatttgagcaacttcactaacatccctccccaccgtcccactttcggtcacaacctaaatttccaaagagcacccttttaaatctccaactggttgcatttgaaattgacatgggttaaagtgtttgttaaaatgtggcattgagtttctccaaccaactaacagttggtggaagaacataaatttaattagtgactagcattaaacaaatgttcctaatattaaacactgccagatgactgaaacacttctgtcagattaccgagagtgccagggggcccacagatgaattttctacacagtatatattctgtaccacacgtttggtgacttcagtaattggtcaaatgtaatttaggtaacagtatgcctaggctgtaaaaatcaaattttattggccatatcaccaggtggatgaatggtagagctgatggcaaagagtttatagcatttagcagctacacctttgacacatgaaattcataaattgctgtaaaatacctccaaggcccttctcaaaaggacactgtttgctttcctatgattgaataatgtttattttattaactaatatactttttgctttcttctattaaatgcgattatggagtagggggtgggaggaggtgttcaaaaggtaaataaaacttggctcttgctagttttgagaatttaaaatctaattggggaagacaggattaacacacctgaaaggttaactaatgttacaagaaagtcaatgattaagtatttgatgagtgttgcagaaagcaagtgtggtaggaatttagcagtgggctgggaggtggatagagatggaaatcttggtgaggggtcagggaaagcctcgtgaaaaaggcagggtttgatctggttttaaaagatagggagcaggttaataactactcatttctaatttaaaaaactattggaaatgtctagattgtttaaaactcatgttctgacctcccattttgggtaatggctgccttcaccctggatcaactgttgatctgtcttaggtttgttctgcctctagtcactatcctttgggtgggtttcataaatggcctgatgtcctctctacctgtgggacacacatgtgactcagtgaccaagcctggcaagaacccaggctgtgactttggagctggggctggctttccatcttggataggaatgagtctgagttttctctgtgtgccgtggagcttacctgcattccctggattcatctctgaaaatagactttgcattatgggatgaccttgcccaactgcccatacacccctgctccccacccaccaatccccactgctgttttaatgttgtccactgaataacaagtttaattgaacaatgaaagtaaggcttttaaatctgcaatgagtccctgtaaataaattctctgtggaattttatgaagctatttaatgaaaagtttgattagaaactattaaagaaaaatagaatagatgaaatttcatcatttagtccaacattacagtagtgtcattttgatttttatttacattgagatattcagaattgagtaaatatatcctggttttaattaactatcctccttacttgggaaaggttattttaggcttgaagggttttgatagcataccatctgctttcttcactgtattttattcaggtcccttccttgcttacagagctgtgcaatgtctaaacctatgacataagcataaattgaatcgtattaatggtaggtgattgaaaagcttcagtctcgacattctgcttgcattcttccatcttgtcagttacactgctcttaaaggcaatatgctcttttcttagcacaagagaattgactatttttaaaacgaaagcaacagactccccattaaagcattatgaaaactcattgtattgcacatgcaattaggaaatgagcttgtaagaccaatgtggggaaagtgatgtgaatggcaattttttcttcataagaatctttattctgtgcataattcctgcctccaccgtcctgttagaatagcctggagaatcaagcattctccaacaacccctaccttgcttttacctttttaaatgattcctcttttgtaaaatgcatactgtcatttatattgtgttatttcctatgcaatagaaaaaacaaacacatacaaacatttttgtctatttttgttgttagaacaataaaatgtccaccactttgtaatgcacagtgtttacattaatatcacacagattgatttcacatgtgtgaagtgttgacagctaaatccaaacagaggcacactcagtacagtagataaaaggataactttaaggtactggcttccatcaaagatatgtaaggcagctcaatatatataaatgagatgaaatcaattattcaaggtgtgtggtactaaatggcttaagaaatggttgacttaaaaaagagatacagtttattttggtctgaggtttgaattgcaaagaagaataagaagttgaagttgtgcttctgagtcttttggcaattgggatgtgtgttggcctgtcatcagctgtttggtccatgtgtagacaccatgagctctgatcttcagggagaaggggttggctatgtcaatatgaaaatacacattctgctggggaccagaaaggagggacagcagggtatagtgaaagagtgctaagcttacaggcaaatagcccaggtttaaaatcagggctcaaccacctgattctctatgcctctgggcaagtgacataaggtccctcacttgccccatctgtaaaatcgggtaataacagccaacttgctggacacagaataagactgtgttcacttgattttaaaaaaccctcttgataaatgaagattctctactgtttctattagtcatatgtcttgcacaactcatactcatccaaaatgatcttgtttttcaatcatgaaggaacccaattccctaaggctcctggggtcttactataatagaactttaatggaaaagacgagttttctactttttacagtatgtttttaaagaggcttttctatctctgtactgaactttccagtcctgtttttcctgtggagtgaaataatgacattatggacaaaagaagaaaaagaaaagggggagaacagaagagatgaagggacaaaaccttgaatttttatgaaaggaaattcaggacgtataaaattaatttgaagcataaaggatgagctggactctgcctcttcctttctgaacatcacatgttttgctggaaatgaaaggcagttgttttgttaaggatcatgggaatttgtaagtgagtaaacatttttttccttgccgaagtaggtttcatggtcacagtggatttcgatgaccaaatggctttgttcctggcccctgtccacattcatactttctctgcctgcctgtggtgcccactgatctcccaaatgataagaaggcagacatttttctttcattgaagctaagtagaaaaggagttgtgcttcttgtatattgctgtttatgcagaagaccttaaccttcagagatcttacttggaggactgctttgttttggaaattttctagaggttttgtttatcattaaagaatggtctaaccaggctgggcgtggtggttcacacctgtaatcctagcactttgggagactgaggcaggtggatcaccagagttcaagagtttgagaccagcctggccaatgtggtgaaacctcttctctactaaaaatacaaaaattagccaggcgtggtggcgagcacctgtagtcccatctactcgggaggctgaggcaggagaatctcttgaacccatgaggcagaggttgcagtgagccaagatcgcgccattgtactccagcctgggaaacagagcaaaaactccgtttcaaacaaacaaacaaacaacaacaacaaaataatggtctaaccaagtcactcttggcactttctccttgttgcatgggctaccaaagtgaaaacaaggagaaccttaaggtcatcatatggcatagtaaaccaaacccaactcagtgctggtagaggtgtaatggatgtgctccgtgatacatgtaatgattaaaagatggactcagcttctaagagagtaagacaaaagtagagcaagagagaagacctccttgggcagaggcctcagaagctagaatatcatttctcttgggaaaagaattttgtgtgttgctactgtaaattaatttacagtcataatatatggaatggctaagattcgaggatttcttttctgtttttggaacttgaaaggagatttaaaaataactctggacaccttttgtagctgagtgggctcaatgggttattaaaaacaatttgggctcatgggtacaataaacttttgttcacgccgtaagaaatgatttgtgtctatattgactaatatttcacctagcatttcatctagaaaagcgagaaagttatatcccattacattagcaacatcaacatatttctctctagggtgaaactgacatttttatcaattaaaaaacatacatgctgcaggaaagaaccaggtcattgaaaaatcacaagcaaaagtgctggtctggggtagtggtggtggagagagattcagaataagtctatgttcgcttgacttaagcagcctccttgataaatgaagattctctgtaatcccctttattatgtcctgccagggaactagatggatataagttccttgaactgtaggtgaggctgtgtggagatgcttagagcctattacagtgcctgacacatgataggctctcattcattcattcattcattcattcatttaaccagggtttattccacagctattatatgtgaggtgctgttctggtctatgaggacaacagttgtgaacgagacagaaaatttcccacttttatagtatgtggaaaggggagtgacaaaatgtgagataactgtggacctgacctcacaggtattgacctcacaggactattgtgaagattaaatgagctaatgagtaaaagcacttagatggtccatgtaagtgctgtttaagtactcattgttaacctacccttcttgtgcctcttgcagcacccaacacaaccttaaccacatactggttctgtagtggttcctcagaaaacacccacaaaattatttcatattgatacagactgctggggaaaatgaagtatgtcatttgctattaaaaatcattccacatcgcttattccagaaatacttgtttgtttgtccctctgcatggaatgtatatccccagatatcacagatctggctctttcccagatcatttgggccttggctcaaatatctcctccccagggaagtcttctctgaccatccctcttccacaagcccagctctatcccatcacccagtgtgtcattatctttctgtaactcatcattatctgaaattaactcctatatttgtttctttacatgtttacagtctgtcccgccccctccacccacctcccccgccccacaacacacacacacacacacacacacacacacacacacactgccacataagctctttgtaaatgtatatagggattttctgtcttattcacagccatgtgtgcaggcaacagagcagtacccagcacatagtagctgtagtaaatattggttacatgaatggatggatacgtttatagcgtatgtcagtatcattgctatcccctgtttcacagataaggacactgaagcacagcaacatttcatggccagcaattggcaaaatcagcatacgtgctcagtgtccgtgctctttgcacctttacattaggctgcctctcagcccagaccctgctcagaaagagctctcagacttcctgagatcaggctgatggaaaacagataactgatcgctagctttctagatgatgaatgtacagtagattttgtaggatttaaatagagagattggcgtgttgggaagtggttaggaaaggaataatcacaagcattcaaaatctgaaacccactggactggaatcaagaaaccctggtgccagccaccaatacccttcatctctgttatgccagcctccttgcctcagcccttgctgtcctttggtctgtttttaacaccccagccagagcggccatttctctgctcagacctccggtggcttcccatctcatcacagaaacagaaatgaggatagggctctttaagagtgcaaactatttagaagttgaagggggcagatagtgaactgctctgtgttctcatggactctgtgagacatggggtttccatgctgacaggactttcattatacacctctccgtgattttctgcttagaatgcattggctttcccaacttggcattattctttaatgaaaaaattataggtctaatttcaaaaaaatgaaatgtatgcaagctttcctgcttctgtcacttttttatttctgtagcacataaatcatttccctttttaaaattaaatttcgcttgccatgatttggtaatgggttttcaaaggaggcagagtagccaagctcttggcacaagagccagctgtactgcctgctcaggaaatcttctcattgctggctggcgtgggccttgattccatcatctgggctttatgttcccttaggaagttgcctagaaattctgtgtcttaaaagctctccttagagtggctgttttggctctccaggtgccatcttggaggactaaggaacacactgtgttcagcagaagaagattggtgcattctaatgctccttgagtgcttatacattcattccttgggcaccaactatgtttaaggcagaactccaggcattgttaggatgctagtgtctgctctctagacaactgaaaaatcaagttgtctgagataggacatggagcaagaggccattacaaatgttctttgtaatcctcttaaaaatcttgcattttacccatgagcgacctcagagaggttaaacagcttctgaagggtcacagacctggcatgttgctgaagtaggggttagcaaagcaaaaccccacacacccccaggtctactgaccccaaggggcatgcttttctgctacaaatgcaagaagcctagagctaagagtcaggagttattttgaagtttaaaggagaggatatctgccaaagctttgtccatgggaaagtttgccatataacagacactacgaggcagttggctaagggcaaagtgaggaggtcaaaccgtaggtgccaccggagttaaaagatccataaaagagagccctaatgtcagaggaagcctcttagaggaaatggatcttcaactggaccttgaaggacacaaaaaggaggaagttatttcaggtgaggaggtggaaaatactctggactttgaagctcaaagagattgtttcctctgccatttttagctttctgcacagacaaaaagcagcctccacaagcaaaaactctttttcttttcctagaagatgttatattcccccgagggagtgagtacttgtgagtcctctcacagacccccatcatggttagaacccaggggaagtttcttggaagaaaaatcaacttgtttcttattaaattggatccttcccttgggcctatgagaaagaaaaggagagaggcaccaattttgcagcagtggtaaaggagtgaggtgcctgcttggtttcctggctgcttaatgggctgcttctaggctaaaagagtcacttcagaataatcatctttaacattttgcttcttgtcccttatgtgttactcagtactttttcaaagatgtttttccccctctgcctgttattaaagttaatggcttcagttgcatttctcttcgctagactctaagctccttgagggggtaagaatcaacatgtttgttgaaatgatacgaaaactctgctagatccgagagggcttcaaatctccatcatcttatctcttttcctggataagtatttcgtgacctcagtctttcagctttagctcattgccagttgatttcattctcaaggcagagtgccaaactcaaaagaactgggttttttctcaatatttatttatcttttcaaaccaaagagacattgttcgtaatctggtcagtgtctttagctaaagattgttcatttgttaggatgcttaaaagacctttgtagttctgcacaacctagaaggatgtcttccttagaaaatcaaggagcgtacttaagtcaggacaaatggtagcctgtatccagaggtcactaacaacctttccaacttgtaacacagataccagaattcgccgtggccaatcaagaaacagtggctggttgcttgacagcatacagggcgttgtcaggtttctaattaaatgtggctctatgggtcaggaatataatatagatcacagtttgggctggaatcatatcggaaagtgttaagtaaaaaaggctcagccagtataacattctcatatggaaaactccttggtagatggtactgataccccaaggatcctttatggatcactggcttactgcatatgattgacagttgaggccttctcttgggagagttgcatggaagatcctagaaaggcaagttcataacacacaggattcagcagggcactttcctcgtccggtcccaggcatgaatattatatctttgaagtaggagatcaaatcttttaacaagggtattacacacaacaccagaaacatgactttatcaaggagctgagtcccgcttcatttccaggacataccccttcagaaagacaatggatgttggtactaattagttcttttgagatttgtcttttctgcagcacagttgcaagtaccatgctctagagaatgcattttatcccatagctgttgaaagagaggaaattgaaatgtgtcaggactagaacaaacccagggactgttatggaggccccaggaagttgccttgcagacccttggtgccagtgtcacctataggagctgaggaggtggcctcagagacatggagagtttggccccgccactcccaaccctggtaactgctcatcccaccctcagtcttgccataagaggaatgtcttgcacatgcaagaagatgcctcatacttttcagagcacctccacctcttctggcctctgcacaactctgtagaactgggagaacaagtgtccttgaccccaccaggaagttgaagaaactggtcaggtgagtctgtggctacacgttagcagagtagtgaatgaagctaaggggaaaccacagtgagactcgggcaccagctactcggcctttgctcttaatgccatcccccaaaatgtggcccagtgctgaagggcacggcatcacagctgtgattatatacagcaaaccctaattaaccagaatcttccataaaccagatgctccccctccttcatccccttagtaccatatttcaaggaggggaaaaaaaaaagtaaatagtaaaaacagcttatatgtttttcaaaatatttttctcattatgaagttatttctattacgaaaagtacaagtagagtaataataataattgccactcttctgtgagcatgtaccatatgtcaggccttatgttaagccctttatatacattatcttgcttaatcattacagcatccctataaggaagctcgcgttaaccatcacttcacaggggaggaaagagcggctaagaaaagttaagtaacctcagcactttgagaggccgaagtgggcagatcccttgatcccaggagtttgagaccagcctgggcaacatcccttctctacaaaacaaaacaaaacaaaacaaaaattagccaagagtgatggcacgcacctgtagtcccagctactcaggaggctgacgtgggaggatcatttgagcctggtatgccaaggttgcagtgagccaagatcacaccactgcactccagcctcccaagcaactgggcggcagagcgagaccctgtctctattaaaaaacaaagagaagttaaataagccaaagtcacaaaactagtaagtggtcaagctggattccagttcaggtctgtctggcttcaaagctggtatgcttatctactctgttgcctccctaaacatcatccgccatctcatcagtgttatcgatttccctccagtctttttcaaaagcactttcatttacttgagaacattttatttatgcaatttcatatgttaaatttctagttattataaagcaaacatttccccatattcttataaacattttataaactccattttaatgattgcctaatattacataaaatgaattgatcacagtttacataatccctttttattagaagtttatattgtttcctccacagttttgttttgttgctgttatgtataatatataattaatactataacaaacatctttatacataaaagcatcagcacttgatggattctaggaatctcttattgccaagattattttccttccaagcaatagcagagaaatcagataatcagagcctgctgtagacctaggtatcttctgagaaccagtgctcagaatgaagatccagagtttcgcctgggctccaaagcacaacaggaaaaaattttcttgagtgaatactgagcacaagcaagaaagtaagctcaggcggtgattttcacatgtgcatcaatttcctgaagcacttactaaaaatttgattcttggggtctgcctcagaccttcagaatttgaatgggtaatatcatgtaacccactttttttaatagacaaaaattgtacatgtctatcatgtacaatgtgttgttttgaaatatgtatacattgtggaatggctaaattgatgtaattagcacatgcattacctcacatacttaactttttttgtaataagaatacttaaaatctattctcttagcaatttttaagaatacattattaactatagtcaccatgttgaataagagatctcttatgtctcttatgtaactgaaattatgtatcccttgagcaacatctccccaactcccccaactccagcccctggtgaccaccattctactctctactcctaggaattcaacatttttagatgctacatgtaagtgagatcttgcagtatttgtctttctgtgactaccttacttcactccacacaatgccctccaggttctttcatgttgttgcaaatggtggcagaatttgcttcttttttaaggctaaatagtattccattgggtatatatatatatatatatataccacattttctcttttaatttttatggatatataataatacatatttatgggggttcatatgatactttgataaaaatgtaatactttgatacaatatgtaatgatgaaatagggtaattgcggtatctattacatcaagcatttatcatttccttgatacactttattttaaaatctattcatcctttgatgaaaacttaggttgactcatagtcttggctattgtgaatagtgctgcagtgaacatgggagtgcagatatctcttcgacatattgatttcctttcttttggctatatacccaatagtgggattgctggatcatatggtaattctatttttaattttttgaggaacttccatactgtttcccataatggctgtactaatttacatttccttgttaccaatattttaatcacactttatgcacacttaagattgagactcaatactgtaggaatgcttaaagttgaagttggttgcagtggtaatggagaatggaagttgacaaagtaattgttaccaccagctcctcccataattgcttctgttcgggtgtgatggaggaactgttgagctggtgctgacaggaggcagcgtgtggtaagaagtagcggctgaaggtagggggtatgttccttgggtagttgcagatgggtaaaaggctttgctaggtaaaagtgcaaagccctgattttggaggtatatactctgtatgctattaactaccaagaaattaagaaaaagcacagtgtactagaaagggcatttgggagtcaggagaactatgttctgaatatgaccctcatacaaaatagggagcttccatgactcagttaacctctctgggactccacgtcttatatatgaaatggaatgtcggaccggtttttgcacttttttggatctcaggtccctttgagaatcagatgaaagctatgaatcttctcataaaaagtgcatgcaaacataataaaaataataatagctttgaacaatgtcattagcaaaaattgacatgtcaggcaaatacagaacattctgcatctattttccaggatttgtagggtatatgaaacctcagattaagaactcctggactgggtgatctttaagaaccttttctgttctcacatacttgcattccatcaatgaaacaaaaaaggtgtttccaatgattctctgtaaacgttacacttcattaattagaacaactcatttccttagaattttaattcatgaaaatatgaaaataatgacattagatcataccttttattgagagcataccatgtatcaggcactgttatgtgcctataatttgtgttcctaagagataaccacttaatgaagtgttagtaggataaatacttcagcgaaaggcttattgaagccaaatttttctaggatttattgagcacctactatgttcattatctcctcgattttcacaataatacttaggtagggattgttaccttctctggttttacagatgagaaagctgaagttcagacccgtttaaggaagtccttcaacacagctgctttagtggagctgggattcaaaccctgctcttaagctgcaaagcagtgctcttacgggttgtgttgtgcttcttttcagtagcctatcaactgttctaattcatttaaataatgattatgagaatctgacttgagctcaatgggacttttgtcaaatatatacagcagtgctcctatgggggaaaccgagtacactcttcaaattcacctgcgtagtctttgcttttccacctctgaacggtgtgaggttttttgttgttgttgttttcttttttgagacagagtcttgctctgtcacccaggctggagtgcagtggcgcgatcttggctcactgcaacctccgcctcccgggttcaagagattctcccacctcagcctcctgagtagctgggactacaggtgcccaccaccatacccagctaatttttgtattttcaatagagatggggtttcgctacagtggccaggctggtcttgaactccgacctcaggtgatccgcccaccttggcctcccaaagtgctgggattacaggcatgagccaccgtacctggcctaacagtgtgaatttaaacactgttattcacttcagccttatctggcatatgtggagcacttgccgtaggtgaattgttcgactaagactcagaggatggtggagtttgtgcctttaggagattcagcattgcggctaaggttccatcactgtacgtagctggctctattctcataggtcagtgtgctgtttgcagcctactgtccataaggcaaactacaacccacgggccatgtgcagcgctcagcctgttacagagttttattggcacactgccacactcatacgcttacatcttatctatggctgtttttgtgctatgacagctgacttgagtatggctcacaaagctgaaaataccaacactctgaccctgtacagaaaaatgtattgacctctgatatagaccaatgaggttcattaaattttaagacatcatttctaagatacaccatttttatatgtgccacattgcatatacaataaaaagcactgctgattaacaactgtaaaatgccatcaattgagatgccaccaattctggagatattgaaatttgaaccaaacagtgtatcttacaattgaaatttaatacttttcaaagtgatgtttgagattgagaggcattaaaataaaaccctgtaaatacggattgtcttaaagacaattttaccctgcccataagtcaaccagtctgttgctccccacgaaacctatactaacagaccatgtgataggacccagtgaattagaaaagcactggcttcttggcatctgtcttcccaaagactgttgctaataatgagtggaagaaatattttggcattgtcctctgatactattttcaactcctgttagtataaatatttggggtgtttcagtacagtgggttgtgtggcagtaaaattgttagttcttttatcttagggctggcatatttgaacagtatgcctgttcttaaaatgtgttatgaggctatgtacaaaaggctttgtagtagtttggaatgggaggcttctcagatgttgcttatggttagattcttactagtctgaaaaatatgctaattatatactagcctctgagcagagagagtgaactcaatattacaattttaaacttcctcaaaacaaaaacaggacaccacgtaaggggaagtagtgattaatgcataaacagtatgtgcctcgtatgtgtacacaaattgtcccttatgtctacatacgtttgtatattcatataaactgcccagacagcaaacatatttgaaaaaataagccatgactttgggaggccaaggtgggtggatcacctgaggtcaggagttgaagaccagcctggccaacatggtgaaaccctgtctctactaaaaatgcaaaaattagccaggtgtggtgacatgccccgtaatcctagctactgaggaggctgaggtgggagaattgcttgaatctgggcatcggagactgcagtgagccaagatcacgtcattgcactccagcctgggcaacagagcgagaccccgtctcgaaaaaaaaaataagtcatggtattttgttttgttctgcttttttttttttcttcaaaaatagaaatttaggaattctgagtcaggccacatattatttggctaattcagctgcagagtaagttattaatgacccccagatgttgtttatagtgattggaaatgtttggttgtgaaataatattttcttttttgtgtgtgcaagtgatatttcttaatatgctctacagcatctgaataaaagtttgatggcagaacagtttgcatgtccaatgtaattgcttctaagtgagctcttcattcttcacatttttagctctaattgctttttttcccatatgtctaaaaataaatatttgcaagttttgtgttctgctactcattgtaatacataaaatatttgtacactgagcaaaattcactgataatgttcacagtgggctatttagagaaagtaaggtttgtgtgtagaggagataaaatacatttttattattcaatagtataaatgccagagaaagccatttatcttactttgaaagaatatttttaaagaagtggccagatatttgacctctgagatgatttaaatagattcagttggaagaaaagatccagtgtcaaaaataatcgggttttctatataatagatattttaaatgatctctgcaaggtggcaattaattttttattatcagggacagaggccccactatgtagattatctaagtccctgacttcctgggcagacctcctctcccttcgtttgagtttattccagctcattagcacctccatccgaaggttggcagagaaaaggagaggaagaaaaaatgaaatcacttctgctgctcttaatggcccttggaaagaatggatcatgaatgaaacagaaaccagtgggaaagataagccattggattttctgtgttttcttttatccttgccttccttcgtcaccacagataatcaatagttggcttaaagacttttaaatgaactgcacattggaaggctttgtagttgtaataccaatatcattattatctttacgtttccaaagactgggtgggtgccagagaggtaaatattgcccggtctccatgttggcatgagacgcgttcctgacctttttttttttttttcaaacctgcccctcccccgcccccaccactgtcgtcttttatgcacagaaggtaattttttgtgggtgttcagatacaaacatctgcttgaccaccctgtcttgtgattatgtcttatgatcctgacctggtgatattttgcattaatgaaagttggctggtttggtcttccccatcatatttacttcttaatgtgttgctatatttacagttcaccaagaacaatctgtgacaaagatctgcttttatcaggacagctgccagattcataccacatctccaggttctgttagacatcacagtaaagtaattctttactgcttgctttacttgagccatctttctaatgtgtattcttgaaagtatcctggctgtatgaatctcaaatttcagtcccttttttagaccaccatgcagcccagaggtttggagctttgtcttggaagctccttccatcaatcagaataccaaatttacattgttaggttccctggaggtgttggagctctggattcagcaattattgtgaataagaaccttgcagctagggtgagtgccaacattccaagtgctagcacaatggaaaagagaagtggtttatgttagaatatggtcacattcttctgattaaacccactcaaaaaagacaacattgtaatattttccaatgactgtttatcatgaattacgtcagccttcgtttaaattgctattatttctccttaatgcttcttggtgcctgcataatttacggcactggcagcctcgggactatgaaataacctttcacaaccaccgtacaatagtgaagaacatggcgtttttgttgttaattattataggactcctttaacttttacaaagtgacataaaatattgttgaggcatttatgattcaagctacttttacatggatctattttgcttctggctagttcttaactaaagcaatcatttgtggttattaggccgccggagatattatgtcagaactggtttaagagtattattatgtatcccatgtcatacactacatgtcagcacttgaggctgtctttcaataaaaacaaatgtaattttagtttgtgctcttttagggattggccatttataagccaacctgagttcattcgaaggtgtcccaaccatttaggagcttgtttcagccttccatcatacacttttagtctctttcctgtggatttaagacctttccaaaacaaactttggcaaaggtttaattcagagtgaagatttgctcctagggagccacagaattagcaaggactggttaatcgcccagggctgagctcgttctgattcccacattttgtgggttttcttacagatttcctaggcagtgagtcttctaattgtgaccctcctaactgtgaccctctgaagagaagcgagtctcagcccatagaagaccctgccttacattcaaagaggctaccctaactttctggcgaggagtcttgagtagaagggaggtggaaacaaaaaaggatgggaacatgtttgagtttccacaaagctacacttccaagcaaactttgaattaatatgtcactcccctgggttccaaatactatgcatattttccagtccttgcttatttaaagcaagaaaggaagggcgtgccagaaagttttacaaagaatgaaaacacattaatgactcatgtgaacaattactgattttcttaacatataatttcttaattactgtcaaccaaaataatttgcatgataatatttttcctcccctcccccatctgtgtttaaaaggcataaaataatgatcaaagagtctgtttgatcaatagtcgggaaatttaactccttaattcttagtggattgatgggactttgacatcggatattcttcagaataatcacctccaacacaatgggcaaaatgagctctccagtaaaacaaacagctttgaaaagagctcaggggcattttctttagcttgaattcaaggaggaaattgtgacttttatgaaacttgcataaatttacatgtatcctgtcagagttttaaaattagacaacatgcctgaatgccctggaaatgagtctgccatccagatttagagtgcttttagcttttttaattaaagacatttcacaagccaacgccagagaagagaattaagcattacataagaacatagcaaagtttgagatttaatgggtgaatattacgaacttataaaggagataaaaagtgtgaaaggagcggttattgggagttttctacattttgttaagtgtaaaaaatggaaaaaatgaaaaggccaagctgccatttgctgtagccctcgttctggaactggttcaaagctcacagaactgactgtgggactgtgatgcttgttaatgagcatttgtggcagtgcactgggatcatgggtttgtcacatgaatatatatatatatatatatatatatatatatatatatatctcagaagatagaagacaaaagttgttgctgcagtgtgattgtgagaaacacaaaacaatcatcctgaagactgcatttacatagagctcagtgccaagtcccacaaatactcactctggattctttaataactgctgatacatagttatcgaaaattgtttttagctgcacatgctataccatttaaaaaacttagactaaatactgtcagctcttgtttgctttcctagcatgttattcatttattgagaaatttggaatgtaaaacatctgggaataacttggtgtgtgcaaaggcatctttaaaatgtgtatatttcagaacttctttggagtatttatttagaaatatgggaaaattctgtaaacatgttctggaatatatgtagcatttgaatatgaaagaggaagttggcataattgaaaacctaaattcatcttctataaatattactctgtcagaggaatgggtttctgaaattagagaatccagattatggtcagcgatatttaccaagaagtatctccttttgccctggacagaatgtgtgaaccagaaacatccattctggccctttctggggtgtaatgtggtcgtgtgacaataacttggttttttctacaacaatgtttatgtctaaataaagaagttaatttatttcagcgtttcaaggcatgagttggagctgtgcaaacccaattgcttagagtacaaccactgtggtgttaatagctccctggtttggttcaacagttagtccatatattttatagccgggtctttaagaaaccagtgccatcaccacaatcatagcaactgggagatgacacaacatggaaaggagtcagagaggagaatttgttaatgatttatcaattttctccttttgggaaaagtaaatgtaataccgaatatcacataactgtttttacttcttctaaatttcacattttgtaaccattttagtagctttaagccctggcactgtccccctgtcccatgttctcttctttactgaactacaattcatataagtggagctcatacaatgaagtttgcccatatagtccagtgggctggactggataaactctaacgtcctccaaacaccactttctggagattgcaaaacccatgtgagcaatgaggttctctagatggtgtgcggatttccagttaaggggcactcttactgtaaccactgtggccatgccatcctttggaaaaccttacccatttacttgtgtctcacagctgccctcctttttgatcctgatagaagcaggaggaagataagggggaaggtccctggagaatctcccactgacctgtgcactgggaggatggggtggagccttgggaatttcacacctttcgcaggaaagaggagctggccctctcctgttcctgggtggtaacctgggattcagtcggtgaggtagagagcttgttaacaagactccatctcactttgctgtgttgcttttcctttttcctttttgcacaacaaattccactcacccttctatgtgtccacaagcctagtccttcctggtcatgtgacaggaacccagtttttttctacaacaatccctcatttgtgacactggctgtggatttcctatcattagagggagatcatcaaaggaatattaaaattaatgtgctttccttgagatattccctgggtcttgtcttgtaaaaaactgaaatgacagaaaagaactggaagcaaaatgtaaattgaaaacaaaccaaaaaaaatctcctcattgtgaacgattcacagagctctcctttaactggagtacaaggttaaatttgctcattgatcagggcagcagaacccgtggtgcccgtgttaacgaacttcccatctgttttcttacgagttttgataaggtctttagtcaatgctggaaacaagtcaaagaaacatatctctgtgtttgtctctttgccctgcttggactttccacacactggagcaagtctccagcccctttcccaatacctagtggatgtggcagatgatcagtcattcagagaagactgtttcacaccccttactatgaacaattcttatctgttcattaaagtaacacttctctgtggacgtgcttggttagcaaatagctgaatgtctgaaagtaacaaaatgcttactagaatattcatcaactcagacttcttgtgcatttgctccttagatttagggcaaggcactcttccccatattgcctcctttggccatcatcattcatagtatattaactgagtgggcctgaaagaagtattgttatcttgagagctccatgtatttgcatgtatgacacagaatccttttgagtcttctcacaccaactgaaccaaatcctatatttatgcacatgtgagcaggtcactgccacattttgagtcatattcttgtaccagaagaataaagtactgcagagctgaaggatttggtcagtgaaaggttgatttggaaagtggaagaggataaggaatttaaagcagactgtcaagtcagaaacaacagactcttggtgagattaggaaagaaaaaaggaagtgggggaatacatagctgcaaccttgatttaaaagacaagtagcgatgtgatattaatcaagcaaaaggaagccttacttataaaatgagtaagaatggcactttttaagagagctatttctgatctccaaatcaagccacaaatatttattgaatagtgactgttctgccctgaactgtgccctaggcacattgaaggacacagactgtttgggagactaagtaaagtagtcgttatgatcagggtcacatacgtgtagataaagtggtgttccctttgagtcttggataccgataggcttctgtatccacacaaagatatggaaaactctgatttaagtgcctgccccctctgcagcttcactttcaagccttgatttccctagttttaaaatggggatgataatcctctcagcacagagtgccttattcatccatccatctgtacttctttctgtcaaggccatcgttcatcaattcaacaaatatttagggataacttattatgtaccagataatccatgaggccctgattaaaccttatggaattaaatcgacatgactcatctgccctaattctagagcctgggaatgtgactagtaagcaagtaaatagatacatttatatttgtacacatacacacaaagagaaatatagaacttaagagactcctaattttgactaatacaacacctgttgtctttgtagcagccagtgattactgcacatgctcaattcttgagtttaatggtaacacaaccactcctttttctttgaggcttatttcagaaaccagagtggaagggaacctttctgttgagtttataatagcaattacaagctgataagggcaaaccattcatcaaaggatcatacctcgggactttatctctttgggtcaaatgtttcctgattgatattgactaccatatcttaagcagctttgaacagataagaagctaggaaagaaattcctttgaaggagatttgacaaaattatattttctgatttttttttctttcgggaggcagattaacttcccattgttcttactaagaagtacaaagttaccaaaccaatgaactgaagaaaatctagaaaagttttcacgggtagatattgattgagtttccactagagacgaatgatcatctgtattgttattcttttcgggttctgaaatggcttggaaagaacttttaaaatatcgagaatggctctgtaccaaagacacttaggaatagacaagtatctaagaaaagatagctacttgattactacatataagtgccctactggaagcagtgctataagtaaaagtcttgcaggttaagtataattcgttttcgtagaacattatttgtagaagcaatgttttaaaaggtggggagggtaggtttctcaccatggacctgatagccagcttttaattggaatggccataaacattgtaattaatcaactatgtactcaattataaagtatataattgcattctgaacagtaaaaagcttccgaaagtgtatataaatcaactaaactgggcaatacagtaactgatcacataaaattatatttaatgagatgtgtcatctatcacagtgttttccacacagttcttatcttacatctttgtgattcatttgtgctttatttttattgcaacaaatctcacagtaaagaaacctctttatcttggccatagaattcagtgacattactttgggcagatttataatgggtatctttaaagagagtttggagacggggagatgtggggtcatttctaattggctttctggaaaggtgatctggatgtgtctgtctgcctttacttattataaatttccctatcacaagcttggctatttgtacttaacttgtggtcatgctactatatccacagttggcatctgttgcctggaaattagctagatgacctacgtttgtgtgcttcctgcgatagctgctaggtgttacaaaagaggtgtaattagaaaaacatgctaaatacaaatcactcttgatcaagtcactgcatgttgagaagtataggtataacttgtgaccatatcatagctcctttatttatgtagtttcttcacattttatgtgtacaatcaagcatgcctgctgaccaaggccagaggtggagtggaagcgaaaaaaaaaaaaaaaaaaagcttatttgcatttttaactctggcaaattggaaagatttccaaaatattttgataaatatattccaaaatggctttcactgagtggaagttcaaaaggtgttcgtatctggtgaatacacaccaaagaccttgcaaattctggcacatgccttgggatggataataaagaaatagctgagtaactgctacagctgttagctggctttctaataaggtggtgataccactcatttaccaccctctttcactctttcagtcgggttcagattccaagtgccttttccatgagtggagttagatgcatgctgagtacttatacccaagccttgttgcaagaaacacaaccatatgaaacaactgaccagggcagaactgccaaatggagtgagctgaaaaccttctcttccatcatcctgagagctcatgtggttattttgatcccccagtttcctgtattacctattagcagatatgtgtggtgtgggcaatgagtgtgctcatttatttatgtgtccaactgacatttattgattaccaactatgtaattgtgtgtagccccatgtgaggatataggactagtacaataaagaacacaatccagtgctaacctttgaggcactcacattctagtggtgggggacccttgacttaagcaattgtaacagtatttaagtactccaatagagctaaatgaatccttcttgtcagattccgtagataaaggaatacttttttaaaaaaattatatttatttccttgaatattttactggaactaatgtaactgacagactggcaagttgtacaagtgactaatatattaatcccactcttcccttctgccttgtgggatcgtcaagttgagtcagggcttaaaaatggagcttgatgagatttgctctaaatatgttgactaacaccactttaacccctaaacatcacatgcaaattgattatgtctctttcactccttttaaagacccaaagatgcacctagttaataacatgctctatgtccttaataaagagcaggctaattaaaaattgtttgctggctgaaaatgaataaatgaagagtcatatattaaaataggcaacttcagcctgcagaaggagccaaataaaagctagtggggaatgaaaggaatattttgagccttttccaccaaagatgaaacatatgcatgacaagttgtatcacagtgacaaggtcctggggtaagaaggctcttgacaggacgggcagccagggttagtttcaccacctccatgatacaaaaggaaacagtcttgttttcctctctttcttcctccatctctcctagtccttcctatctgtcaagccccatctggccacagctccacaccagcctccttgaatctgtccaactcctggaggcctgcaacatgaaaagtcttcactgtagtgatgcattagcctcacagtatctcctttttttttttttttttttttttttttttttttttttttttgagactgagtcttgctctgtcgctcaggctggagtgcagtggcacaatctcggctcactgcaagctccatctctcgggttcaagcgattctcctgcctcagcctcccaagtagctgggactgcaggagcccaccaccatgcctggctaatttttttgtatttttttgtagtagagacggggtttcaccatgttagccaggatcatctcaatctcctgacctggtgatctgcccacttcggcctcccaaagtgctgggattacaggtgtgagccatcgccacctcacagtatctcttaagaataaaatggtccttcccttgtgctttgtacagccgggcagtatgcaccttttttaacttcttgcactcgtttctttctcccttaaatatgaaaccctgtgtatgtccttcccagaaaagaaacccccttatcattgcctcacccctcagtctggccaatttctccttctattctggagatctcaccttaaacatcacttcctcaaagaggtcttccctgacattccagtgagttcagcacccttgtgatgtttcttactctcaccctttcataacactgatccagctcaccttgctgcatctctcttttccatgccaaaacctcagctttatgggaggaaggagaaagggcatcctggaaacgccttgtccctggtgtgcatctgcttatcctaggtagccagtgaatgttgaagggatggatgagttaactctaagtcacagaaaacacacttgattctgcgtccctggaaaacaagaatcctatctcatatttctttggttttggtcacaatgctatttggtgcccaagaaatatttattgaaaataattcttagatctgttgtgatatttatctcagctaggaatgagaagagtttcctttaatgatgtgggggatagggagaagaatgaacgagcttgggcttgtttgctttcttagtttgaagcagttacgcaagtacaaaaatactagtttgtagtattgagtgagcaatcctgtgttaagtgtgggcctgttgtcactgcattctgcttttcagcctctctccttccaggccactttgtctcagggaacaaagtctgttcccctgtagggtattgaggcccactgctttgtagaggcaggggacgcagcaacaagaagatgaactctggatctcagtctgcactcattgtcactcaccacctgtgtgctcctgggcaatgactcaccctctctcagcctcagtttcctcatttctaaattgacaatcatgatactactcacttcaaggggatatattatatatatgaggattaaatgaagtgctgcacataaagctcttagaaggggctgggcatggtgactcatgcctgtaatcctagcactttgggaggacgaggcggatggatcacttaaggtcaggagtttgagaccagcctggccaacatggcgaaatcctgtctctactaaaaatacaaaaattagccgtgcatggtggcgcatgcctgtaatcccagctacttgggaggctgaggcaggagaatcacttgaacccaggagatgttgcagtgagctgagatcacgccactgcgctccagcctgggcaacagagcaagactctgtctcaaaaaaaaaaaaaaaaaagctcatagaagtacagtacctggcataaaatatttgcaagagatttacaatacgcaccacagctaacctaaatcaagggagatctgctcgcctccatctgctctccaaaactgttcgtgggacactttgaggtggcagtgagtgcacagagaggcctaggctttagaatatccagaatattgcagagccacactattctcacctccatttttttatgttccgcctcctgtcctgcagccctaacccttatccatgtccacgtcatagggactgctccagttccgggtatgccatgccttctctttatctctactgctctccaaaagtcagcttggaagttgagaattatatctatctatgtagtatattttgttctctgataacaacttatttttttcctgtggcagagcaattatgctcagtatttttccaagttaattgcatagagaagacattgtctttgattggaattaaccaaaatgagaatatatagctaagaaagagtaggaagacaatattggatctaaggccaagaattaataattgtagtagctagtgcttatatactacttattatgtgccaggcactgatctgagctctgaatcatttcccctaatttacagatgaggaaactggttgtctgtaggaaccacagagtggaaagagtatataatcagcctagttttgcctgtaggactccatcctcatggacatttgtgttgcttcacttaatatccagtaaaagagggagatcacctcgtaacaaattctgcccttatttagttcagattttcgactcaatgtatcaaagtcaatattaatggactcaattaatcatgacattgaaatatcaaaaacaaagtgtgaggaaaacacactgtaaagtgaaatctatgtctcctttaacgatgtgggggtaagacgtacacagagcgtttggctttagcagaaatcttagtctttgatgtggaaaatagaaaagttcttgttgtttccatttgggtcagagaaagagatgatcgccctatgataagtttattgggttctaaagctagatgtaataattgacgagccacaagctgtcctgccctgaggatatgcaagtatgaaatacacatgtcaggaaaaatgcagggtttttcttttctttttctttttctttttttttttgagacagaatttcactctttgttgcccaggctggagtacagtcacgtgatctcggctcacggcaacttccgcctcctgggttcaagcgattctcctgtctcagcctcccgagtagctgggattataggcacctgctatcacgcccagctaatttttgtatttttagtagagatgggggtttcaccatgttggccaggctggtctggaactcctgacctcaggtgatccacctgcctcggcctcccaaagtgctgggattacaggcgtgagccaccacgcccggccaatgcaggtattttaagtaaggaaccgcacaacaggaaaagcagaatatatttaataagacaaatcccagttagcctaagagtgaggatttgtcataagacagggctgcttacatggatgagtggggggctgaagatggaagatctaagacaaataactgtaagtaaacaatttttggtgaatcatcttactccttaacagaagccagcaacccgtagtggccttcttctggatagctgcttaaggagggaaatattttaagtgtggcaatgtcctcagttttaaacaaattttccccatttttgaaaatgatcacacaattaatgcctcttgcatgtattcaacaatagttgcctagcaaccacgaagaagtgtttttggagcgcaaagggtctaaaaatgaatgaagaacaaatacagtacaacttgcagctgaaaatgaccgattttctgatatcagtttcaaagtacatcccccaggaatcaggcaagggctatgcatctttaagagtaaagaggtttgagctgggtgcggtggctcacacctgtaatcccagcactttgtgaggccaaggcaggtggatcacgaggtcaggagatcgagaccatcctggccaacatggtgaaaccccatctctactaaaaatacaaaaattagcctgtcacggtggtggatgcctgtaatccgagttactcgggaggctgtggcaggagagtcacttgaacccaggaggcggaggttgcagtaagccacgaccatgccattgcactccagcctgcatgacagagcgagactccgtctcaaaaaaagagagtaaatctgatctggcatctttagagacccactgaaatgtcctatttgtcttggacacagacaaagaggaagaaaagtctaaactacaagaaggacctcttaagtgtagattggtccacttttctgccttccagcaggactgctttccagctaatcccaaatggttgtgtaactaatggagttttgaaaaactcttaagaaggaggattataacaccttctttggtaactctctttgggattttgcagcttttggactgagaccacttggtaaagaccatgggttaatcaaggaactaacctcttcactgtaggtaactgacttataccattggttggctttcacagtcagcttatttgaaatgaaaagacctgagagatctttcagatgagaagtcacaagctcaggtgcccagagttgtcagcaaagaccctagcagaagaagggcagttgaagcctgtaagaaatcaggaagcaggaaacacccatgcacggtctaaaggagcagctgcttttcagctccagtcttcactgtgttgtaggaatatgagcccagagttgccagatctctcaactccttaagaaaagctagatatacctatttttctgtgaaaacctcatgattttcaattgatgataagaaaaaatcatgcgagctaaacaagctataccactggacagatttggtccagggactgccagtttatgacctcctctcttgtctaatgagcccctcattttacagatgagggaactgaggcctggtaataaggatacttattcaaaatcagtgaaaatgtagccgggcgcagtggtgtgtgcctgtagccccagctaatctggaggctgaggtggtaagatcgctagtggccagccagggcaacaaagtgtaagactctgtctctaaaaatataaaaataaaaaagtagtcaggtgtggtggcacacacctatagtcccagttacttggaaggctgaggtcggaggattgcttgagcccaggagttcaaggttacagtaagttttgatcacaccactgcacactccagcctcagcaataaagtgagaccctgactctgtaaataaatcaatgaaaacatgaactatttaatgtcaggaactatattgtcttctctgtgctaccccaactggactagcacagtgtcagacatctgatggcagtttaatatttaggccgggtgtggtgagtcacgcctgtaatccagcattttgggaggctgaggcggcagatcacgaggtcaagagtttgagaccagcctggccaacatggtgaaaccctgtctctactaagaatacaaaaattagccgggcgtggtgatgggcgcctgtaatcccagctgctcgggaggctgaggcaggagaatcgcttgaacccaggaggtggaggttgcagtgagccaagatcgtgccactgcactccagcctgggtgacagagcaagactccatctcggaaaataaataaataataaataaatattggatcggtgaatattggatgttagaaacaaaaccaggacttggtttggccaggacaaatcagaaccttaaatgtttcatcttaaatgactcctttctttccttttctcctaagtgacctaccctaacttctatataggtagaatttggtctcctattttgccacctaggggcttgcttaaagtgagatttgattaataggaatgttctactgaaaacgcgagagcaaaagccttcaaccctctatggggcccaaccttcctgaaagataagtttgtctatactgggaaccctacgaccaacaggttgccattcttcttggcctaccagattaaattctgttcaatttgttttctatttattgagttcctgcaatgtgctgaggcttgtgtatggtgatttctagatacaggggattccaatgattccaatgagcctcgggacttaagcattgaatggggattctccaagcacatttcagaaacatttaatgattaatttagagaataaggacacttggcatagtctctctctctctctgtctgtcactctctcgcgtgcactgtctctcatcctgttgaggcacactttactttgtggtaatttcctttcttcagtttttgccttgagatttaaagttgcctgaaacacagaatcaattatcaccaagataagttcttccttttgacaacccagttattgcctctatattggaagacttgtcagcatagacaacagttcaggctctaaggaagtataccagatgccttttgtcaaataagtagctttcctgcacttatctttcttcctgggctctacaaggtgcttacctctgtgctaagggcccaggtgtttccaaaatgtcagtaactctccaaccagcaaactgctggtctcttgaaatgcttgaaatgatgtattaatattacttccacgtgtccgtgcatataatagtgataataatggtattcaccatttattagtgtcttcagtgtgccaaataatgtgcaagccatgttgtctaatgttacctcattgatactccttacccatcataatctttcaagatgggcatataattctcttgacgaacggttaaattcagcccggagagagatgatgacttgcccgaggtcatatagttgccttatgtataaagtgaatacagagttgcctgctctcaaagcccgtgccctctctactttcttatgaaacttgggtctccaacagcaattttgccaacttcaccagtgctgtgatgatggaaggaaagatgacatatcttttttcagaaggaaactcaaggggccattttaaatggagcggatggttttgcatgaggctatgtttaatttcgggatgtcgtccttttctggtgaagataatcagacgtaatgtcatctgcaacctctctgtgtgcatgatttcataaaactggtatagcagtttattattataaaattagtatagcatagaacaaacctgggatgcaagccagatgaaatagacaatgaatagttatataaggttttggaagcacatgtagtagaacacaagctcactgtattttcttctcaattgtctgctgtttgttaatgtttccttttcaacatgattgcatctcagtttaatagcacttgccatctcaggctttatggtgccaggcctgacatagttacatcccctctgtgctaaaaatattgcatgtatatatttaaccgcagctgacatgtttagctaatgggttactcaggagctatgcgcttatataattaagtgatatatgtaattttgtgttaacacatttgccatgtgtgtttccctggtgattgcaacgctttattctgtgtaaagtgtgacattttaattcccgctgaacaatttcctaccttgatttgccttgtttttgtggcaggggattattttgcaatcaagataaaagcattatttatgaaatttctaggctatcccattactgggaactttgaactgcagatcaatctcctattttattgatctttgttaaaaatctttattggaatttaaatgtaatctctacattacagatttgctcagactttcatcggtaggcacatttttttaggcagctctgcagagatggggttccttaaaaaaggaatcctcaccaggcagtctgccatcttccccagggaaattttttctcctaggtgttgctgactttttcttgttgtaggggctctctaggagagccagtagcccggtgggcttgagagtcttggcaaaacaggtgagatctgtgtgtccacagacaaggtgggtttctgttaggtatttaggtgtttgacaatagctgggtctcagagttacacagtgggcattacaatgtgggtgtatatgtcttccccttattaatggtgatggtgacctagggaaggtgctggagataggaaggtgaaccatcaaggatagcctagccacctggccctctttagcggcatttatgttctccagtgggatgagcagtcagtgcagtttaacaaacatttaccagactctactaagtagtaccagacactgatttcaaaacatgacacagagggaggcatttgtttagtaaacgtttattgaacacctactataatgatgctacagtgatcaagaccaacataatctctttagactgtggtaaggtacactaaccagatgatttcagtacagggtgccaggtgccaggatcaaagcatgcttgttttttgcattttttcaaatttgttattaattattttaagacggagtctcactcattgcccaggctggagtgcagtggcacagtcttagctcactgcaacctccacctcatgggtttaagtgattctcctgtcccagcctcccgagtagctgcgatcacaggcgtctgccaccatgcccagctaatttttgtattttttagtagggacggggtttcaccatgttggccaggctggtctcagtgtgagccaccacgaccaacccaaagcatactttgtacaggtattgacaagggttttctcacccagctggagatgagggagagtaaggaagctttttgttttgttttgttttgttttggctgggggtggagacagagtctcgatcttgtcacccaggctggagtgcagtggcacgatctcggctcacttcatgttctgcctcccacggtcaagcaattctcctgcctcagcctcccaagtaggtgggattacaggcgcccgccaccatgcccatgtaatttttgtgtttttagtagagacgcggtttcactgtgttggccaggctggtcttgaactcctgacctgaggtgatccacccacctcagcctcccaaagtgctgggattacgggcgcgagccactgcacctggccaaggaagcttttaagcgaggagttagggcaggagggagaaaagctaaaaaagaaaaggtatcgatgtcagaggaagcccaggaacaaaggcacacaggtataaagctgtgtaatgtgcttgggacctctgaggcatgagttactgctagaaggtgaggacgatgctccctagcacagtggcctgtggtccatttcttcttgatcccagaggtcctgagttcccaaagcccttcctcacccccaggagggctcctttgttttttcagcccagcctagcaagcaggtggcggttgttgacgcccaatgccagagcactttcctgatggctttgcaagtgttttgctgctagtacctcacatttgggtctgagcaaacagctgggagtatggtgcacagaagtcctgccagaaggacctgcgcttcatgcactccaagtgagctttcttgcttgtatgttttggcatatgaacacagtgggaatgtccttgtcagctcccatttgactttattaattacagttccttggaaagtgtgtttcagtaacatggtcttgggatgacagggctcaccctgcagagacccaaatggaggtattcagggcccattgaaaaaccatctgctgccaaggctctgctgctgatctcatgcaacagaaaccagagtctgtcgcagctctgctactcactgggtgactctgggcgagtggcaggctctctggtcctgtcttttctgatgtggagaatgactagctggtgcccgaggttttcctaaagctatggaattccatcattttataaatgactccaatgacgaatcctactggcataacatctatggtttcaccaactcttagcagtgatctttggttccagattcatgtgaaaagccaagaaccgctttccacaatttgtcttgtcatgactctccggctccatattttaagaagcagtctacactagcccttgaatctagactctaattttttaagatacaaaggaaatcattaagccccagaatattagtagaatatacggcaatatggatcaagtaatccaaagtattagcaatgttgcaagaggctgtcacctagcagctctgtattatgtttccaggccctcccccactcatttccctgagccccgaggctgtggttaataacgtcaaaagaatgttttaaaattgcccttctgttgattccagagagttagggccctcacatggttagagtcctgggctaagagtcaaattctaaatttaattccagcctctatgaacatcttagtcccatatttcctcaccatttagagatgtttcagttttcccatctgcgaaatcggcataagatgccttgctccacagaaatacttgtcaacagctttgccgtacacaaagattggcattgtattggggcaaaatatcatttttcattccataataggaattaaacaaaagccctttgagaacgcaccttgtgtaaacgccctgtgcttaaaagcctgtgaatttcagaggtcagcaaaaaccgccccccttctttattatttttcttaaagctaaacaagggtaactagggaattcattttggaatataaagacatgaaagaaagggtatttcagcttgcacaatagtacaaagaagaacaagagttgtcatgttttgctaaagaactcccagctgtttaattttatagtaaaattactttaagaactttgctaattcaaagacaaaatcaaacaactgttgttgcaaaactgaacttccacatttgagtggaaaagccaatttgagattaatctgcccctaaaatcatattataaaaatacagagcatttctgtaatgctggttggaggagtggcttttatctgaagagaagacacataaaagagaaaaatggtacatttactggtagtaagatttaaaaaagtagtttatgttctcatgtactttgccctgacttctcccccagctttctcttaagctcttcagtctgttttaataccaggtttgtttgctttctggggatgggcctgttaggcaggaaattgttgaaaggcatacagcagaaattttaaatggtgtttttaaaagataaatacccaattgggtaactgactattaaatttggagttcagaattttttaaaattttatttttagacaatatagaaagataaattctgtacctatacttggttctataagtcccacatgttgcctattgtcagaaacaaactgttccttatttaaaaaaaaaaaaagaaaagaaaaaaagccagtttttcttccatattagggaattattcagacttctttccttggttcctataattccaaaccagttggaacatcagtctatttttggtttaaaggagcttttaaaatgtgagcatgatttttttaagtttctaaatctcataaaaatcaatttgccacatatatagcagctatggttgtaaatatagtgaagtcattgtattgcagaaagacaaagttctaatttccatattacaaaccccacctaccccaccttgtccaatctccacataagagggctgaaaatgtaaattctaaaacatataaaacaacataaggttgtcatttgtggctgtttctatccaagatgaatgttgtcacctgtattggagtaaactcttttgttagtttctgcgggtttttttggtcgtcccaccgcatcccatcgactcaccacgagagggcaatggagcgtttgctttcagctaacaaagctagaaatggttttaatatcagctaagtgtttgaacttgttaaggatttatttctccaccttccgattgccatacatgcagcctccgagtttccactaacagcgaataatgatccaaataaagttattctgagggaaaatatagacagactggtgcagacaagagcttttgcccaaataaggatcccttttgtgcagaccccatgtgttagataaccatcaactgacagttgctcatgagttaataatgttggatgctgaaatatgcataccatgtgctataaaagagtttggaggacaaagacaaatacttctatagttagatatcagaaacataccagaggtgtgcagattgcttcgtggtacataggttgaaaccgcccaatcatttcatcaaaattagtacaatataagtatgatacagtagaatgtatgatattgattgcatgtttcattgatgttgcagaaattttggtctaagcctttctgcatgttactgccttaaatgctacagcaactactgccttctaagaaaagaaaatatttcctaagcttctttctatagccaccattgttgctcttttatttttaccataggaacccattttaccatgtgtgtgcagccttttgattggcatgtagtgtttggagggctgttaatgtctagttaggtttctgtgttgctgctgccacaggaatcaaaaagtgaggaggtggagggaatcagctttgattttggctactataacaagttgtttgggaggatgggacacagggcaaactgagcaccgggcagccgccttctcagtgatgcctgatggttttttggtgctaagaatgattgcggaaagaatgtttctcctccctgcccccagagttcaaacctttttgttctgttcaacttttctgggcttattggaatgccagtcttcaatgaataatctcatattttgtcataaatgggacctgaagcaggttggcaaagccaatgaggctatgcccctgcatttaggcctgactgtaactgacctctctatttattctcagatgaaatgtccaaaaagtcagaccattaacttactcaatagttggagattaagaagtgtctacttccaagcaactaaaatcactccagctccattttctcctattcagtttgtactggatgatgaaaatggcttacattatacccgacccatattgacagcaggagagaacaagtcatgaaataaataattagctagttccttcccctctctctctccattctcactctctctctctttctgtctcttctccagtctgttgtcaaagcttaacatttactttgacatcttagttaagaaagttaatgaaataacatcttcatcagggccatttagtagccttgagtcaatgattaccagatttgaattttacagaagggagacctcagcttaagaaaaatttttagatactattataacattatatatatatatatgtgtgtaatgtgtatatataactatatataacgtttttacatgactaccctccataacagtgaataaaatcttaaatgtattgaaacattgaatcgtgacttttgctgattattctagcttcagatgttaatcttgttctgtctgctccttaacacatatttccaagaacatatctataatcataacattgaattattgactaaaccagcatcgcccaagagaaagataatgtgagccacatgtaatttaaaatattctagtaaccacattttaaaaggtaaaaagaaacatgtggagttaattttaataatatattttatttaacccagtatattcaaaatattatcatttcaatatgcaatcaatataaaatgttattaatgagatattttacttttattttgtattaagtcttggagatccagtgtgtattttacactgcggcacatctcaatttggacttgacatatagtatttcagatactcaagggacacgtggctagcggtgactgtatcagacacagcaattctaaatagtcatagaaatgttttatcttacagtgaaaaatgtaaagaagctgtaacctcttctgggttcattgttagctttacattagggtttctgatggtatctgtgtgctgtttctctatagtgtaacaaaccctccctccaattgagtgatcactctagcttgccccacggcttataatctgcccttagttaacatgtcaccaggtattatcaaccttgttgctgcctctccacgcccactccaggccccaaagctcttctcattctgtaccctcaccccaccctgctccaagacacacgctcttctatacaatctgtgagtttgcatgaggttcttggtaccacagaagagtttttaaagtcattttccagtatcttggctccggtacctgcacaaacaaatgaagctcagagaccactgaggtacttagttggggatggtgctggtgccctcatagggaggaagggtgagagggatttgcctgaacaaagaaaaatgtctccgaatctcagacaaccaaaaatagtcatctttttacttttaagtaaaagactatcctactattcacattattctttctgaaaggtataaaagcacaaagtgagtgaaaagccccctttctgtacaaattcctttttggatctttttaaaagaattgggagcctatcacttgataactgtttcttatgtgtatgtcttttaaatattaaaatgtatcccatgacatactcatccaagtatgtcataagttaaatatctccatgttaatccacatacacaccaaaacaaaaacaaaaacaatccatctcttttacttatttccaagtggggaatgttttctgtagagaggtagcaaatcagttatcctcaatgatgaaatggaatatctcatttccaaacctggagaaatggctgaacaagaatgtcctgtttataaatgagtttaaaaactgttctgatatttactgctcttacaaggctattcagtacaaaaatgttgctttcacttctgtgctgtcatgttcaatagtaacaccaaagaacatatcaatcatagactagaacgagcagatttattgattgtaacaaaaagaaaaaagagagagacaaaaaattaactctctttgtttaagaggttctatctgtacaaccttcagaaattgtggaaatcaaaatgtccttaaaacacatttccagagcagatccttaaacagccttaagaaaaaaagacaattatcttgttaatattatatttgtattatatagaaccataccaagaaagactaaatctgtatttatagaagagttttcaaaaaatgaaaacaggagctatttcaaagtcataagaaaaaaacacatagtatagcattgaaacaacatgcttattctcattgtaatagcttctgtgcatgatctccattgagagaggagcctggggcctggaaatggctcgtggacacctggcatctggagagatgaataggagaaaggagttgccaggtaaatgtgaaagtgggagtttgagccttgatggcattttgagagtccacttttggttttactgaatttgtgacttgacaggaccttgcagctagctggtgggtggcatgggctgagaaaacagaccctttgcgtgcagtatcagctcctagatagcaccaccgccacacccttaggtgtgagctaagtcctaagatgtccgctctgccctgatgtctctttatagaatatgtggaattctggctgtgcgtcgtggctcacgcctgtggtcccagcactttgggaggacgaggcggttggatcacgaggtcaggagatcgaaaccatcctggctaacacggtgaaaccccgtctctactaaaaatacaaaaaaaaaattagctgggcttggtggcgggcgcctgtagtcccagctactcgggaggccgaggcaggaggatggtgtgaacctgggaggtggagcatgcagtgagccaagatcgcgtcactgcattccaacctgggtgaaagagcgagagtctgtcccaaaaaaaaaaaaaaaaaaagaatatatggaattccaagacaaaggattctttccataggctcctgatcctcaggaaaacctaggctgtggtcttgtccatgctatggtatatagaccccattatcccaaagatgcataggctcttgcacagcagccatgagctaccacgtccacttcttacaaggggaccctccaccaagaatggtttcccctggaggatattgcagacagccaaatagaccagagagaaggtgagagttggaaaggtctggcatagatttcaatctcttttcctatttccagaattctccccttagagagtcaatcctctgaaaagccagactgtctcctcactcctagattcagctcccagattttccccttgtttctcaagcagtagtgaaaagcatctataatccctttcttctttgccagtgtgtttgtggacacccctattatacagacttctagaacatttttatattacgttggaattcactacatgatttcagaacaatatttaaataacgtgatcatttacatttctcccttgcctcaagacacagtgggggaacaaagatagaaatctgcctatcactgctggtaaagctgacttcaaaaaaggcttgcttgtgttttaatggcaagaatgcatggagtcacatgctttcaaaccaattagcaatacagatgagctaggaagtcctgttccatttatgggttgggggaagggtagaagtaaaataatctgtttttaagtgtttctgagaaatgaagacctccagggcagagagagacggcggatcaggaaatagctatgcaaatcacatgcctaagaaattactaaaaccttgatcaggagcattaataattactccagcattcacaagtatgaaacagagtgagtaagactgggcatgtattggaatggattacaaaagtgtttacttacatggtttgttgagcagtcaatgaagtccatggctgttttggacttaaactgcccaagcaatccaggtatagcaaaggcagtaatacattactctcattgttgactcttggggctctcaatgattttgacaaagaggcaaagtgacgacctcatatgaagccagcttctttttttttttttttaaatgttctttctaacaccacaactgctcacccttccaggaggaagaacaagcacttggattctgtgagagcagagttcattggaaatgctaaattgtagtttgtggttcaagcagtgtaggggtatgacttgggcaaaagcacacttggaaactcaaagtccaggtctttatatcgcatgatatccagtgtgatgagtgtaaaatttctctagggcacatccatccattagtgattggggttgtctgctcttgatgacatttgaacatgaaaagtgtttaaatctggctctagaatttgggttccagactctgggttcatttgctctttttttttttttttttttttaagagacaaggtctcactctgtcacccaggctggagagcagtggcacagtctaggctcactgcagcctcaaactgctgaactcaaataatcatctcacctcagcctcccaactagctaggactacaggcacatgccaccacacccaactaattttcgtagaaacaggggtctcattacattgcccaagctggtctcaagttcccggtcaagcaatattcccacctcccaaagtgctgggattacagtcatgagccaccaccagggcttcatctttttaatgcctttatctgagaaaaaataattactctgaagaggaaactgtcagaacaattgccaaataatgaaacttttgcagtattgtgtttccatatctattgttcaaaattcatcatcagagttagaacgtcgcgcaggatcaagttgtgcttgtcaatggcccagtgtgtttatatctcatacaatgcaattgcttctcaggcatttctgttgggtgtggaagactgattttgggaaaacagaatgaaaataaacttgaatatttcctaaattcgtatgtgatcagtgttttgtgaatttgtagaaagattcaaacaattgaatagaaatttaataccaatggtcactatatgaaatataactgtggatttgaaataaaaatttcagggacttatttatgaatttttaaatattggctttaagttaaagccaaaatgaggtctgagagcttctagttttcttttgttcccccacatatttgaaaactgaaattctgtaagagattatctgtgaaatgcctttctttcattacacccataaattttaggagtggctttgatcaagccttctgccattcttggtttctaagtcttttactcatacgttaataactttaaaaacattcgttctatttttgttgtaatgaaagaggaagtttccaaatagttaaaagggaaacattgaaaatagaacacagtaaatgataactaaattagggtaggttactcctcccccccgaaagagcaatgctccatgctgaaacttgccagggtattttttttttttttttttagacgaagtcttgctctgttgcctgcccaggctggagtgcagtggtgcgatcttggctcaccacaaccaccgcctcccgggttcaagagattctcctgcctcagcctcccgagtagctgggactacaggtgcacaccaccatgcctggctaatttttgtatttttggtagagacagggtttcactatgttaaccaggctggtctcgaactcctgaccacgtgatccacccgcctcagcctcccaaagtgcccagccagtattttaagattattgtctgaaaagaaaatgtgccagagaattgatatcctcagaggaaaagcattacagaaatgcagggtattatcagtaacgcatactatacatagaacaatgtttgtcttccctaatactgtgatcagtggagttttgttttctggctcgtgtttaaaagacacacgcaacttgcaaatcgaatgagttaacgctccgccgacttctctagacattgacctcgggggtcaaactcttaggaaaattgtgctggttttccattcccctgattccagtccctaccaacaagtaaatcctatctctgagtggaagctcacaaagaatttctcgagagaatatgtagctgtgttggcaacaagtctctctgcaaaatgggaaggaagagttgttaactgatgagtcaatccagcttttatagcagtttatctatcttcgtggtatttccaagagcataaatgctattaaaaaaaagagacggtcatgacaggaagaacacagtagaaaaaaacaggaacatttaagccaaaagcaatttactttgccagtaactggttacatttccctttgttttattattattattgcaagagttggggttgacataaaagtttcccacacctgcactgccctgccatgtaacttgtgtgaacccgtagtgaaataaatatataaacaaattgtctgcaactcagcttctagaccctttaagaaaaacaaacttgttttgctatattgttgagaaaatagactataattcattaatatttgaaggagtttaaaaagaaaaaacaaacatgggttagctgtcagagtagcctggagctctggaggtagcttgattctctgaggattaacacctatagaaatagcagtgacttcacaaaggtgaatagttgttaatttcttggcactgagtaagaggaacagatgggcagtcagaggggaaagattttttttttaaaccacagagatctttcactgattaggcagaagagtcagtggcccactggttaaggagggtaatatgtagggctctctgactaagttttattggccttagtgggagtcttgccacctactgctgggtcaagactaaaggggaccccactcgctgtcaattctgtcggacagtgtttcctgtctggggtgggctgcagcaccctcgtgctatgtagtacttgagtgttttcatttgcggagagctccctggtgactgccagcccaagttagtatgaatacttcattttgaggcaatgtgtgtgtgtctgtgtgtgtgtgtgtgtgtgtgtgtctgtgtgtgtgtctgttagagataagttgcttaaagcaggggctctggataaagtccagttgcctgtgttgaaatccttctgctgccagtaaccatttgtatggtctgagacaagtaatttcatctctgtctcagtttcctggtctgtaagatggggataaggatcatgccttcctctttggcttgctgtgagttttagtggaattattgtatgcaaagcactcagaagagtgacttgtacagagaaagtgctcagaaatggttagctactattattattcacttagctactcttattattcatgtataatactgaaaacattcatgcaaagagcatttactgaactctgtgataagccaggccagtgaatcatatacacacgtaaaagtaacagtacgtctattgctttgcactgttttttttctaataaaactgactgaagccagatatgctatcagtaagggtactgctctctccctagcagagctttttcttggtagagatcagtctcacctaaagaacaagagctggtctaattctggagtcttaggatttaggttctgtcagtaagtacatagcactgagctttcaaggagagggcaggtgtaggtccttgcagggtggctggaaggaggtggggctgtctcttacatgagtgaattaaagtccgcagacccatcccactcctgcccaccagcacaccataatgcacctgttttcactcactgacctagcaaatgacagattatgactctagagggacaaagatgtggcctggggaccagaatttttgctgtccccaaagccagtccttcaataccaaaactttacctggagtcttctgaatccaaaaggtctctgattcgattgcagaggcacctacccagtcctttgtgttccattccccccaccccgtactttgaatatttgtgctcttcagggtgtttgtgcattgcatgtggggactagattatagccttactgagataccaaaggcctttggtttcctgtctccattcccagtgcaaactcaagtcaccagtttatgtttccagagcataagcataagtagtaaaggtgaatgcagttttacaagtgcccagtgtgacaagtataccacgtgtgaggttggcgggaccagtctatgaggacaggaaagaacagtatgtgggcatctttatttccattagtcactttttcattcaacaaatacatgttatgcaatgcagccttttgggtgttgtgctgggcagataaaagacacatcccacagggtcttgcccttaaggattctccagtctggtataataatatgccaaaaaccacagctaaagtacaaggagtacagtgatatgttccataagagaaggagggaaaaaaagttcagaggggagagtaggagaggaatttgattttgagtcctgaatgactggtaggatttgcctaaccatacctgaaatacgcaagtacttgccttactaagaacaaagggctttttctcttgatcaaatcccatttagagtttacgtttgtgtgaccagaatattaggtgctagtctgttctaaatttgtaattctcagaatctgctgggggagtacatgtgcttctctgggttctgaaaacagctcaaagaatggagaaaataaacccagtttggggatgacttcttgtcagttcccggaacctttgcctttatttaaaaacagcatgttcgatgcaagttctgtcgaaaaggcctttgggatttgaaagcttttctagaaataaatgccttttaggtctaagtgcttttcaccaaaatgctaggaagggaagatcatagtaacaagtcttagaacagaggggatattgttttgtttgttttaatgaaatgcctgcgacctgctaccccaagttttgtttgtcagctttctgctcagctgttattttgataagggacttgaaagtacatccttccctcgcggtcattaaagtcttagcacttgggtcagttgtggaaacacttctgtgctacacaaagtcttctaaacaaaacaaatagtccatgccctggctccaggctgcggaccgtgtcaaattcatggaacgtggcatcgtgctctgacaaggagagcaagaggtcaggatccacaaaacaggccggatgaaatcaccatctccgtgcggggaggtggagagagcagagccctccctgccagtctggcaactccagcaaagtcctcaggctcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggaatgggtaatcgctactttctctttgcttgatttttgtttgtgagcttgtttacctttggtaattccaggctggctttctgggatggactttcagaccagcgtttaggggaatgagaggagagagcgggtgtgggaaggggatcctaagccctaaagcctctttttaaacttttgcctctctgattttaaaggcagttctgctttactgagcttccaccaacagtaaaactgttatccggaggagaaaatcaaattagtaggattaattgtgtttgtaaaatgagtacagtgtaaaaatgtcctaaaaccactggttaactgcctaagtaagattaacaacaatcaagaaggttcatgttgtttagatttgacattgtcataatcactccttaagtaataaaaagtgtgggtgccttgaaaggtctgaaggaaattgtttagggtataattcattagcttggagtcattctaggggtggttggttagttggttgtttttaattttgcttgacttgggtgactgatgaagttaaatgtgaaagctgatgccggatagtcatagctctcaataaacagcagccttttccccctactttctgtgtagatcttaaaaggaacaagctcagcatcaaggatgaaatagaactttgatttgtatcttgtcttttcaaaagtgtaacccccatggaatcaggctaaccccagtgtaatctttggatgttatattaaataagccttaagatcttcataaaaatatattgaaaaggaaaagacagcatgctgatttaaatgtatctgtcagatttgttgagatttgaaacttgctggttgcagtattgttagtaaatatatgtaataatgttttccagcttgctgttgtgaatgcccctctctctatagctatctctctacttatctgtatggtaatttgagagaatgcccttgtctctgaatattttgtaaaagagatgttttcaaacatttcattactatgataccataagggcaggcatgtcacttaggtttcggaaagcaagatacaaaacaaaaaccaaagattgagctcaaagcctggctcagtttttcagcaccaaatgcttcttgtctaacaacgtggaaggacatttttcttatcatgatcctttagagctaagagcttcgtgttacttctattaattagacatgttaaagctaaatagattagctttgggaaacgtgtacagaaatgtatactctaccaatatgcaagccttcagagagagaagcatgtaataatgagggctgcctgccacagatctgtacatttctctgaacaattagaagggatcactgtagtgagattctgggtctttaataaagaaacccatgcaagtgaaaatgtatatcaattgttttccatttgttttcagcgccaaatcttaaaggcagaccacgcaaaaagaaaccatgcccacaaagaagagattcattcagtggtgttaaggattccaacaacaattccgatggcaaagccgttgccaaggtacggtcattcactccacggtattcatttcgttgcatctttttatttttgctttttctctttatctctctgtgcctgtgtcttggaggcagttttcaattcagcatctgactttggtattcagagcttttgaagctctatgctgtgcctgttcctgccacctcccttcccctggttgccgtgggctgggggaggtaggcattttgattagtcaacagaaagacttcctacctcccagtttggcctgttatgagtaaaggacagatgattaagcacccacgtcattgaggctgagatttcatagtgggtgacacaatgacatagtttactctgcttgtgtcaaaaatagaccagctgaaccgtcctctttctgaatgtgttcatctaaatgtgttttggagattaacagaggatgaaattagaaatagctagaattaatctttttagttatgtatttttcaaagtcacttctaatttacattagactaaaattaaagatacatagcaaaatatttagatgtatacatatgcccacaagcatttatatacttttaaagatctctgttaacatagaatgaaagtaaattctacgctgttgttcaagacccaggtcaattttttacctaagcattctttggaatcttgaaagtgcatgcatgcctgaagtattttgcacgacaaagggtaaagtatcactttatatttttagacttacctttctgacttttgtgggcttgggtcagatttccatggttctgtttactgcatttaggtgttatttttgtgctaaagacagcaatcgtccctttaggattttagttgacgaacagatttcaactgacaccagtttccagatcaaataactaaacttctgaaaatgggaccattttgattagtggtgaatttggaagagtctgatgtagaaaaaaaaaaacatgagttaagttctgtgttgacagtctactgtttctctgccatgtactctacctccttcccagtgtaatgaagtaaatcttagactttcacattctaaaaaatcttatctttaagcatcattgtttcattaggaaattttaaggacttttttgcttagaatttcttcatacttctaagattccaaagggttaagaagagatcaaccagtagaaatgtgtattttccagtttcttgctgaaaacaaatctctttccctaaagttattgttgttttgcacatttaactttctgcgaattaactccacatggatgccatgaatgacattttcttgtaagttggacacctcagccctagaactatctacctaggactttggtttccatcgtcttgaaggatgtcagcaggaacagttcattccctactatgtagtttgcaagatcctgcagaatggcgcaagaaggtttcaagaccataacattcagcagagcttgtactgcccatgccttctgttggtgcccagcccatccttcttggttgacagcatttgtttactccagcatattctgtacctgagcccggcaggataaagctccttcccatgccacttggaatcaccaccaaggtctgcttctgagaattttacagaactcatacaattgatctgaaagagcagacctccaatgtttctttccatggaaggcagctcagaactcactgttgggttcacaaagccgagaagaacaagagcctgctatacagatgggccatatttgatgttcactgacttcttaacaagaaggatagaagtcagtcctgggttttctaagtgacgcctttactccatccccgcaacagtgctgcccgtcagaatctttacaaagagatggatcattcttccaccgttggtgttcaatggtgaacagatgaatgtcatgctgcagtcagctcctagggactggtctaatggcttggctcttttcagagtcttggattacagtcatgccttggctgcttccagtgggtctggcaagaccacttaagcaaaaagatcagtaggtatgaagtgtgacgagcttgtctgttgacaccaacaggcagatgtaaaatccctacagaatgaacaagccacatctgggatgaggacagtcattaaaaagcatgtgtgtcttaacatggtcttttctcatgaaacactgcagtagagattatgagtctgtgaccatctaatcatctgttgaattgaaagcagcatcttagaggacagtgagctgtttgactttgtgaccaagacccatgtgactgtttctttttaaaagtgcctcaaacagaccatttctaactaagcaccaacttcatgcagctccacacagcaaagctcttagagtgggacccactgggtttgttgtgttcatgactggaaaaataagtcaagtgatttgccggtcgccatcaaaacgttgcactccctcaatgagaacatgaaaaccagctttgcaagaccatgttttccaacggagagagaattacatggctccccaaagacagcaagtgtcacgtggggaggaaactaccagttctttgaagatctcatgactgtgttcagcccaaatcctgccatttttttctggaataatcttaaagcagtgaacctgaggcccaggcctttcatagagtgatctataacagaaatcttcatggcataggaccctaataaaaggcctacattgatagaaggcaaattatttttaatatcccgtatgcattttctgaagggcagaagtgtattacaggtggtttatattctaaaaggaacacaaaaaaggaaactgtggtgggaagtgtgttcatttaaaccataaacatactttctatatttcacaaatgtgatactttcattattttcaatatttttcctctcatttggtcctcagaactattcccagggattatcatttttgctttactaaggtagaaactgagggtcacctagcaagttagcaaccaaaccaagattagaactctagctttttgtattgctggttcagcacatcttactgccccagttgaaggctggattagttataactcaatcccgtggaaggatgtggttaatatcaaataggtggtggatcattgaaaacgttaaatgttgattctttaattagcacctcctcaatcattttggaaaccccaaagtacttagtgaactcaacaggtgtatggtgttcaggtcaggaaaaacagatctagtaattaactgtcaccatcaaaaggctgggctttcttaggtcaacatgaagactagctcccatttccactaccacctgcactgtaataatttaatagattgaaatgctgagaatgctttgggtaaatgtaaaaacatacagaaaggaacttgatttagtcctacccagaatcagaataataccctaaagagctcatttatcttaactgaaaaaaaaaaatatcaagctagaacaagaaaagaagcttctgtttacttgttcacttcttactaagtacctggcctccccaggagcagcatgctggcaagcccactgagattcaggacagagttcagtaggcagcagcctggcttcatttggagcctttgctatgtagcagggagtctgggttactttggacctggttcatgcacccctctgtgtcttctttctgtttctgagtgtttctacacagatgaggaagagggttaagcagctctctacacaccaaggagctcaaaccttattctccttttaacagtggttcttctgacctaataatataggtagttggcccattatcactgcaaatttaagactcagtcagttttgtacacaaacctgagagatctactcctttatgttataaaattggggtttggagtggggcagacctgagttctaaacccagaggtctgccccttccaaaccatacatgacctcactaagctctagtttcctcaactgtaaaatgtggctaaatatctcccttttacaattctcaggaacatgaaggtagagtatgtgaagcccacagcactgtatctagctcattgtaggtgctcaattgaaaactgatttccttcccctttgctcaatatacaataggaggaatggagctccttgacacattggaaaccccctagatttgtcttttgcttttcatttgataaatcacatttctaagtggtaggtttcgtaatgcctggtaataagataggctttttaattagaagtttgttttcattaccaatttaatatttgtattaagagtgtcagaaaagtataacatttaaaaccataagccctaaagtaaggctgcctgggcttaaattccagattccccacttactaactagggcatgatcttgtgatgttgtacatgctgctcatcctgtctacctccgtttcctcatttctaatacgaaaataataactacctcattcgggttttaagtttgaaataacacataaacagcgttgagaatggagcctggctgcccaggaaacactcaggaaggggtgggaggcaatacaaattaaaactggagtgatgttatgatttcaagaagccattaaattatagatttcatcagaactttagatccaacagcctaaaatttggcagtgaaaaatgatgacaacataaagtttcacgggatgttcgccttcatataatgttagagagtacaaaatctacatgggaaaattgttttagtcccatttccatagccccttaaaagttaaaatcctacctagaagccccattgaatcagtttcagaggaagttttatctttgcaggaccagtcgaaagatattaaactgtatgtgttcacttgagagaataagcaatgaagaactcctgcagagaatgtactttcctttactaaataagcatagtcttttatgttcttaatgcttaggaaggaggagctgcagggaaagaaaaaggttcgaaatcctgtaatggacagcattgtagaatatgtgggacatttttattcgtaacatttccccagcacttgccctcttctctcccgatgtcagttacggagatgtaaagaatattggaatgtacacattccccatgggcacacttgaactcagagtctgaccctttgtacttcccccttttacaattaaaatagctcagcaacttagtgttatatttaacgaccatcaaagtcctcttgtagaacatggcagtgaggagggaaagttaggttagccgctcgatatgccaagttccctgtctgcctacagtgtggaaggaagaacatctggagactttaccgccttttattttttaattatggagctttatactcactcttcttgggtttttagctgacctctactctttcttttgtggcaagttaacatcttattcttagagctgactgataaagcaagaagccctcattaaacagtgagatcttttgtttcctactgagggtgtacccccgcatcactcttgggtggcaaacagcagaggccttgctggtattgctgatgccagcatctgctggtattgacttgtttttcaaggttgctggagagaatagcaacaagagtggtttactacaaagaaatagacttgcctttcattttgatacaaagtataaaatatggttctatttgttaaggaggcagggtttgttcaaggacattaactgatgcttctccttaagaaaataaaatgtattgatatagagagacaaaagaatgtttctaccagatgcaaaggctatctctcatttcacatcaacatacttgtcaggagtctaaaagaagctggcatagtttggcaaactatgacccactggctggcaatttctgtcaataaagttttattggaacacagccacacccatttgttaacatattgctgatgcctgctgtcctactagtgttgaatagttgcaacagagactgtatgacccagaagcctacaatatttacgatgtggccctttacagaaatttgacatcccctggcctcagacaattcatcttcagtgatgcctctgaaaagctattaaaagcagggataatttaccggttcacccttagcactcactgaaaagtgttgctggctctgtcactagctatgtcttggtaagcatcctggggctgtgcctcgtctgatgtggtatattttcccttttccaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagagtgagtatacttgttttcgtttctgaattatcagagctgctcagattctttgaattggaaaaaataattttgactcaggattatgttgaaatcctaatctggggatagtgctctctgtttatactaaatccataaatgttccaggccaagaattttttccctgcctttttccgctacattgttcccttctgggacagttgcagtgagatatttataggcttgaatccactgattatgactggaaatagacatgttgaaagtttctcatttgctgttttgtcaatcttgagtgtctgtgacgcctttcttgtgagataataatatgacgtagctttatcaggcacagatgttgcctgtgaaaaaaacagcttttaaaaggaggacatttaaagatggacaaaacaaccacaaagggaaaacacatttcctaagccccaaatgtgttaaaatataacaaaaatccaacttcagagaaaacaagaaatacacaaattggaacagagggcctaattttgaattactttgacatgtacatttaaatataagtgtcattgtatatttgcaaggagaacaggaaactcatagccaaacagaattccaaatcaaaagagaagaaatccagatcctgccttgattttgcaaccgaatatatattttgcctctgtctggatttagtggtgcacaaagcgatgagcctctggcttgaaatagtattttctccaaatgtatcttcgtagattaaaaccatgtgtcattttgatgaagaatgtcaaaactgtgtgttttacataacaatttacatacctaatagcaattggcactgattgcaggagaacactcgcagccattataaacttatataactacgaatgattacaatgtttgtctgaaaactggttgcttgaaatagaagtaaaattaatgtattatgaacagctttgttgcattatgcattggttcagattaaatcaaggccgaggcagggctcttgatagctctgaagtagtgcaaggttcaatgaggctttgcgaacatgttgtgtcaaagagcctttaaaaataaaaatcattttattcttcatttcccttaccaaggaatcacttgaagttcaattttcccctcatgtaaaaaaatcaaatccatagcagtcccattccatggtgtttggtataaatgaacagggttgctagcaatttggtatagttgtttaacagcataaacatatacaaactctgcaaagagaaatctgtttgaaaaaaatatatttgcaacatcacacaggccagttaggggactaagtgggttcatgattcaattcctctctgaatgaatgtcttccttcccttttatctgttgtatcactgtggcctccacgtgaaatatttgttttcctactcactgccagccaccacatgttggtgaaatactgtatgaacctttaatatagtgctgccatcagacattctattaagaaggtaatcgtatattaaagtggctgttatttattgattatggagagttcttatatgagagaagctctatatattactgtttaatcaatggcgtctaagggtcgaacaagaccaaccccagttttgagagcccatgctttttcccaaagacatctaatttagcttctcttgctctgctgatgacagtaggactaaaactcttgcctttatcctaaaagtagaaccatttttgtagctttatgactgtttcttaagaaatgttttaagtggtaataatagattctgttgtcaaatgccctttgggcaaattgtttcctaagaacttagctctctggggtactttagtatttctttttttctctttctcgttgaaaaaaaaaatgttttaattgacatttcttggaagtatgttaatgcaatgcttatctaaatacttattgtccctctaacagttaacctttggactatgtttcaagctgctcaaaaactgggaggatatgaaacagtaagtgtttaagcaacttaaatgaaataattttgcaatctaacttttcccctctctttgaccaaaatggagaacatgcaagggcaaaacatcactgactgccttttcaaatggctctacacttttgggggtttattgggccgctttggaaacagtcccaattagttccaggtttggcaaaattgtaaacttgtcgtaaaaactacaagtggaaaacatatgtaactctcccctgtcagggaaattagttgggtctgtaattttttcccatgttgagaaagggctattattgtacaacaagccaagattgcataaaagaaatttcccttggcaacatacctgacatctgttcatgtctaatatgggaaatgtattaaaggctttcaaaagtaatcagtattggccattaaggaatagaatgcagcagaatctcctctcattctagggcaaagaagctttattagacaagggtcagtgctgcataaacaggaagttatcaaacttattcggaacaggctctgacactctttatcagctaattctaactgacagcaatgggttatttttagcccacaggaaaatttgatggccacggatttttacagcatgtattttgaaccaatgaaacattacagcaacaaactgagattaaaatctttaaataagaaagagctgcataaatataacccacagagatgacatctgtaatataatcaattgacataggaagatgttgtcattgggaatactttctcctccacacaatgatcagattaagttgtgtagtttcttcttgcaattgaataagaacttattttttcattccctgagaagtaatctgggatatctctgtaccatagtaaaatgacagtaagacacacaaagtcaagaaaatgaaattcattttagcccaaacgtaataaccagtgcttcttgccagataaagcacattgttccacaaactaatataatggtttgatgtgcgggtcttgggatggggaaagaggacaagcattatgtggttcagataatctggtattttctgttgagctatctgctatgaattccgactaaaaattctttcatatgaataatatgtgcttgtaatatgtttcatatatggcgtatgtacacatgtttataaagaaatatagtcacatggactacatataaaatgtgcatttcatattcataaatttacttgaaatatttattttatcaagtgacctatgtaaaaatagtaatttttcacttagtggagtcttttgataggatcaggatatgaactccttgccactgtagctcatagtttatggcaaaatcttgagctaattatagccctcattcatgtaaaaaaaaatggtaacttattcagggttagtctcataaacgtagaagtcaacccaataggctagactttcaagtctagcttttaatgtttagaataggaatatacgtttttatatgaaccatgactgcagatagttatatgatattgaacaatattatgaaacgtcttttcacactctggaactttttgttattcactgatagggagagtgccaacaatttcacagaatcagtttttcctgcttttgtgtcttctgtatcttcacaaagattttttttccatgcaacagcaagttgatgtagaatgtacagaagaaagtttaataaatttcagggcatttgcagtactctttgaacaaatagtatttatccttttgttggatgaatgaatgaccacacaatcagcaaaacacctgaccacatatttactgagtaccttatgtgtatgaggcattgttttagacactgttagatgcaaggtttcagtcaggccagtaatttcagtccttaagttgcttaccatccaagagagccaataatgatcaaacaaggtggaaaaaggtcagtgccctacacaggtaaagtacttactcacgtagagatgagagaaggaaggcttgatggctctgaggccatttgggaagaattctggggaatggataaaatttagacatgaatgatggattatgccttccagaaagagagaatgaatcaaataagggaaaatatatggaggtagaataaggttgggcatggagagtttgaaaaacataaaatagagtgatgaggtggctgggacaagtggccctgaagggaagtttctagagagaaggatggagagaagatggaaccaagtgaggaaagtcctccgatgctagctccctgatgttaggccttcagatgctaggccctttcatgctgagcctccagatgctatgccctcccatgccatgccccaaagttattcattaggctgtgggaactatggaaagttgccagttccccatctctggtgataagagtcgcccctctttctggtactgtgtgggcgccttctcaatgggaaatttatgccctccttttaggcagataggcagataaggggagggcagagaactcttcctgcatctgttggttctctgttgccctcatctcaaaataatctttatgccaacgtggcataatttaggggtgacatattctgatccccttcactggggctggggaatatggaggatcaaattggcatctgctctccatctggtcatgaacagaattttaaaaggcatttctgcttcatcccttcctcatttccttccttccttcttcctttttctttctttctttttaaatgtttcatgctatagattggccctgcagatacttcagtttgccaccactattctacatttaagcttctgaacctcctataagtacagaatacatttttctcttggcatattttgactaataaaactgtgagatgttcaatgggcattgaattttgaagtcagtccaggagatgtacaaataatatccaaagtctgaaggcttaagctgtcatcacagagttactagaggacacttatctttgacatgatctgatatcagaaacgagtgtagacttgtagtcatttagaactcaaaagagatcttagagtcttctagatcagtggctcctaaaagctactcaagaatagggctcatgtttttaatggggaactttaagtggttgtttagacccccaccccaagatataaactgtggtggggcatgggcctgagaagcagagaatccttttcttttaagctgcccaggtgatgttaattcaaatccagtgataacagtgataagtaacacttagccaagtgtttcccatggctcttagcttcagagtgtgacccctatctaagtcaagtatcaaagatttttcttcatgccattactacagaaacagggtagaatactcatattccttcggctcaagagcagcagagagtttctgacaagtatttttgcatttggtaaaatggtagtctaagttggaactcagtaaactatttttgttttcaatgaggggaagtgtagaactgtagtactctcaaattattttttctcaaattggcctttgtgcaaaaaaaaaaaaaaaaaaaaaaaaagtatgcctgctgtgccccagttcatagcctcattttacaagcgagaaaactgaggcactgggagatgaaatgagttgcatgggatcatcatggctttcttcaaattctgactcactgagaatttggtacacaattgtctcaccctctgtagcgttgctgaaagagatttataaatgattattctttgtggctttccattcctagcaatcactaatctaaaatgcctcctacatatttggggcaatgttttggggaaaggatctgataacctgccttttgtagcatcttttagtctgttttgtagcatcttttagtctcttctttgtatttaacatttgtagcttcttttagtctgttttttgtatctaacatgagctttaccagatgtactaattactagctgagatttttatctgactcttgagaacaaaatgtgtgaattcaggagatgagtcaagaagtatggataatgtaaatattcaataatagtaaaaaactgcaagtataaaagctgtagatgtattgcttctgcggttaacttgtgattggataaagacatctctctggaatcccttctggttataaaaagaggccatcttaattggcttgtttttgtttgtggttataaactattccaaaccttctggtttgaattgcggattatggattatttcatttcagtcctctacaaccatcaaattgaattaaaaaaaaaaaaaagaggagcagaagtttcattgtaagcctttatagcatttgactaatggctatatgcagttctctcagtctcttctgcctttgctggaaatgtatagagtgtttcttcatccttaggttgagagagcataaatatattgaatggatttgatttcctacaaaacaatattctggcattttgattaattgacgaggacccttcctttgcaatgtacccaacttttccttccaaacattagaatgtggatcacctacatttgaagaggtagagctggataaatctttgctgatgaactaaaaaggctttcacttcagtgtctggtgaagcaattaatgctggaagagtagcttggggtattaccaggatgcagcatatggcggtggtttgctaaagtgatttccatttggctaaccacttgatggcaagccagaggcagtatctggagagaaggtagagttgggaaatgggtcttgagtacatcttgtcctcaaggcacagggtgatacacagtggtgccttctaagaatgtcagttagcaaccctttctcctgccaccagtgagacagggccattgttcttcatctggaagaagcctctttccttgctgaaaggattaggctttgacatcaaattctggctttgacatcatttttaagacatcctctgaatctaaccctagttttctgaacaggcaaagcctctcgcttaaattcaaaattctccaggccaaagatgatgtcatgtagttttgaaaggctccagttcctggagtactaccaggaaaagaaagtcatcttccttgaattcagtccaccctcaaggtgtcctgagaaagaagctgtttctcagaacagcccaggcaacattgctttcaggcaaactcttctgttgacttcgtatttcctacacattcttaagccactgaaagagtttaagtctgaaagatttctgatacctatttcctcaccaggctgcaaaaataccagaattatttcattcctgcagcctcaaagatagagaaatcaaggctccaagagcatgtcttgagctaaaatagtgattttccactttttttaagtgacaggatattttcatccaataaaactgtggaagggacagattatttttccactcaccagaccagtcttcttgaccaggtgggcagtgtggagagttactttcaggctacctttaaaacgctacctgggttctaaagacaatttattttttttgttggttttttgtttgtttttgttttgttttgtttgaggcggagtccctctctgtgttacccaggctggagtgcagtggcatgatcttggctcactgcatcctccgcctcccatattccagtgattcttctgcctcagcctcctgagtagctgggattacaggcacccactgccacgcctggctagtttttgtgtttttagtagagacaaagtttcaccatgttggccaggctggtctcgaactcctgacctcagatgatccacccgtctcagcctcccaaagtgctgggattacaggcgtgagtcaccatgcccgtcctctaaagacggtttgaaacccactatatttgtaagcaatgaaaattttatgaacatagtaggtgtggagtgcttttcacagagtctcttgggtcttacctacactagggagaaataactttcaaatgtcttcaaagtgagattaaatctcacatgcacctagattggtttgttttacctgggtgtagtctgctcagtttttcatcttgcgttatggttaattgtgtgaagttatgcttcccactaaattatgaaccttgaaagcagtaacatctctttcttttcgtgacaccatctcacactctaccctccctcccttccttcctttcacttccatatctctgcacaggcatagtgcccgaaaatggtaagcattggtggatggtgatgtgaatctgtcatctaattgcggaccttgaagaggaggcacagctcaaaagaaataactgtgtggatgaatttggctattttctttaggaaacaaagagccaggccaggcacggtggctcacgcctgtaatcccagcactttgggaggccaagatgggcggatcacgaggtcaggagatcgagaccatcctggctaacacggtgaaatcccgtctctactaaaaatacaaaaaaattagccaggcatggtggcagtcacctgtggtcccagctactcaggaggctgaggcaggaggatagcgtgaacctggaaggcggagcttgtagtgagccgagatcgcgccactgcactccagcctgggcgacagagtgagactctgtctcaaaaaaaaaaaaaaaaaaaaggaaacaaagagccagaagttctctgttcccctaaaaagctaatataatagaaggtcaggttgaaacacaaattataaccaggaggcctgaggcttagtgagagagttgatcaaactagccccttgattagatcaaattttccagctgattgaggctgggtactagacactaggaggcagacgttggttttattccagatggaattttaaagcttacccacatcgagagaggacattggacaacagaataaaaactataagcaagtacataattaggcacaattaaagcatgttaatacagaaggcggatttacatgaagccgggagatgtttccctgccctgttctctctccttattgggctctgagacccatcatgtgtttggacaatgggagaatttagacatttcttcctctagagtccatggctagtgtttgaattacatctagagaccaaaaaaacagagatgtgtgcctaggagacctgtgtacttaacagcatttaacagttgtgaagggcacattttatgactttcccatggaaagaaaatatctcaaaatggcccaattcatccaggccattcagtggaagctcagtaaatagaggaaccacttcctcgaagggccagacctgtcttcactccagatgatcctcactggtaaaaactgtatttaaacaccagaacttactaagtgctagggggctgacacagacccctggcctactgcacacagcttattaatgcccagcggtgcttgatgttggcttcctgtggctaccgtttcaaacctagtatgagatagattatttttccctcctgtgataatgcattatttattcctaaagggtcttttcttttctctgatagacaagtgtatcatagggcattccctcgtttagatggtaggatggggagggaggcgtggtcagtttcacaccctaaatatccccggctttcttgctcatcagttttcacaatttatattattttattgatatatgtgttcactcgttgattgtgggtatcccctactagaatacagtggtcttgcatgctggtctgcttttcattgttgcatcccagctgtaacatttgttagcacagtgcctaataaatgggcgatgtccaataaatttttggtgaattaacggatgagtgactggatggattctgatataattgagacttatttgtgactcggtggtgaacttaatatagaacttcttttttttttttgagacggagttttgctcttgttgcccaggctggagtgcaatggcgcgatctcagctcaccgcaacctctgcctcccggttcaagcaattctcctgcctcagcatcccgagtagctgggattacaggcatgcgccaccaccccggctgattttgtatttttagtagagacggggtttctccatgttggtcaggctggtcttgaactcccaacctcaggtgatccgcccgcctcggcctcccaaagtgctggggttataggcgtgagccaccatgcccggccagaacttctgttctaactagagatacaagtggttagggtggactttatgctttgagagtaaaacctcagagcactgttaattcaacccactaccttaaattgatgctgtcctcttagctagatttccccattgggaaagactcaaagctaaaggttgagaactcacagcagaaacagtgattcccacagttacctgcctcatttgaaggaaaaggctcccagagttctgtgttaccaacttgttacaagcatgggctattctcaggtcattctgatgtggaagctgctttatgcagtgaaaagaagtccactcttgagaccagaagacaaccatatggatcctagttttggtactctgctgctgtgtgtcattgggcaagtgtgcagcctctctgaatctcccttcttctgtgaatgagatttcctataacctgcctcacaggctatgggaggattatatgatgtcatggatgcgaaaatcctttataaaatagacagtgtacacaggagacacaaggatgatcagagtgatggtttcttaagtgattacagggccacacacaggctgttttctaaccctgttgtcacccccagggcccacaggtctcatctgagtgaggggaatctggaggtgtgtttcaaggggtattctagggtctttgaggaatcgtgtaggcacttggaggtatcctgtttcttctcccttgatatgtgggcctcagattagcccaagattatatcatttaaaggttggaggcagattgtaactaaatataaaataattatcaaaatacatattttgagtgttttgaaagggcgttgaaaccatttcttgtaatctaaaacaaactgtaaataaggaggattttattttcagttacacctgctagtagatgtaagaggtggttctgtctagtgagaactattgaaaccgattggtgcaagaatgcttcatgggaaattgaatgatgcacagctaacattgtctcgaggtcctatttgggcctgttgagaagggtttatgaaaatgaaggggttctttctatttgaaatagaaaaggtaccatttaccccataatatttaaccagccacctcctcctcctcagatttacaattacagagccccggttgcaagttgaggttttttaatttttttttttttcatttgattgctgcctttagccccttggtgaactccgctggcagcctcgtgggtatttttcaaaagaagcctcctgcttgactgtattaaattccactggcacctttgccacgccctgtcccctacacattcaaataacagagttttcccgtaaccctgttgagaaatgttcacgagggccgcagaacttgttctgtcttccaaatttcaaggaaatactagacttacttggatgtagtaaatgacatggtttccccaaattaatcatttgccagatcttgcatctgttattttgtaaaatcttaatttttgtacaaaaataaaattaaaggaaaaaattaaacaagaccatagtgtgcagctcagtatattacaagctgtttgtttttattcactcaactcaataatgtacgtagctagcattttaactgtggaatatgttagttttcatatgatttgatcaatatcccattttcttgacctaagtgaataaaaataaacagcttgcaacatatacagtttcagattttggttttgttttggtggttagagaagctggcataaaaatatagcctgaaatgactataaattccacaaccaatttgatcatttaacttaatctgtgtagtaattttatttattttttaaattggcaacacatctcatggatggaaaatcagaagatacaaaagcatgtttggtaaaagactcttttttacctctatacccggttccccatttccacatgcctcaggcaatgttaatgttgattcatctaaactgttgaactaagatatatttcagctaaaacctgattttattttgatgctttatcaaatgacttaaaggaacagggtatgagtatgagtccttgacaaacctacatgaatatccagggaggtgtcttaaatgaaacgcacttaggatgacaaaatacacatccaaaagtagaattccatttttattgtaaagaagagtgctgaaagcgagatctcactatgaaaccataaatcaccccatatactcttttggacttctctgtttctgggtttccagaacagactgttctcttctgactgttgcatatgtattgaagcctggcactatgaatctcttatgatgtaagattgaatttcccattgccattttttcagataacagcccgccgtcagtggaaacatatttatgatgaattaggcggtaatcctgggagcaccagcgctgccacttgtacccgcagacattatgaaaggtaagaaaccatttcatggaattgcttagttaaaagtgtgttaattgaaaggagcttctggtcaaggataagacagaggaagtctaaatgaccttttgggaaactgaaaatttccctctggcattttactttgcataccgccttgtgatttttagggaacatggctttctcttgttacaggggctaaaattagatgttcttttagtttggttctgtcatgtgaccacctgcctgacaatgccttttttttttttccccacaagcatagattactcaggatgttctctttaggctctcttaacatgagaacctttagcttctgaaaaatctgcaatgctactctgaggttgacattgaaaagtaagcacttctcataatattagcattgaaaagtaaggatttctcatagtaagagaaatggccccagatcaaatctgttgttttatttcatcctggtatttttcttctacggaatcttcttaccaagctctgtgtggcttggttttctaacaatttcagcctatttcagaaagatgatgaggatgcaaacaagaagtaatgcaaaattagcctactatgttgcatccacaggagtggatttcccgtttgcattaggactccattattcacaccgttaaagaccagttagcagattaatgcattatccctctatgcttcaagcccatacttaatttgtttaggtcattaccaacttccttataactggcatttccctttgggtcttatacgtacatcctcaggcaataccatttaactcatcaattcttagtcctttttttccaagttcaattttacttttatctgtattgcatttaactcagctttagtatggccgttcaacaagaatgtttttgtaataataaattgaattgggtttagtacaccatgaaaaattgctacaaagtattcccaaaggattgccttacttggcagggttgtaattcagaaggatttttaaaaattgataatagatgttcaaattattactctttatagcattgtttttcaatacaacacatcaatttttaaaatatgttatttctgtcagtgtttaatacaaaaactcacccattctcactgtatgtataaggtacaccactgatgtcctagtacaaagtagcactgatatctcaggtgagtgttccgaaaataatgtctaaggaaccacaggctacttgtttttgacttatgagtcaaggcttcattcagaacttttttttttttttttttttttttgagacggagtcttcctctgtcaccaggctacagtgcagtggcatgatctcggcccactgcaacctctgcctcccaggttcaagcgattctcctgactcagtctcccaagtaactgggactacaggcacgtgctaccacgcccagctaatttttgtatttttagtagagacggggtttcaccatgttggccaggatggtctcgatctcttgacctcatgatccacccacttcggcctcccaaagtgctgggattacaggcgtgagccaccacacccagccagaacatttttactagaaactctgtccctgttttcaaatagattctgttttgagagtggacatccctgtcctttatatgcaaatgccctcaacacctgaaccatcaaacataaaggagcagatagcaattaaagcttgaaaaaggagtgtatctcagctgttagctcatctagttaaagaatgaaaacatcaatcaaattaattacaaagtatcacatggtaaaaaaaaaaaaaagagagaaggtttggcatggagagaaggactcaacccatagtagtgtgtgtgtgtgtgattgagcaggtctgtgaataaaagtaggattcttctgaagattgtgtacttttgattatttacttctttcaggagattcctgaaagctttcaatcacattagaaaattttagtagatataccacaaactttagcaattaagaaacatgattaaagatgtcttaaaatttttctcttctctccctattcttgggaccagattggatattccataaaggtttgctttctcactcgattaaactttttgaagagtggtgtcacttttccaaatccagaatttggtcagtgtatgagtcagggtgcagtaaggaaaatggaaaccacactgggtattcaacaaagagacttcaccataggcagttgcttaaacaggggttggtgtgaggcactaagttaacacgggggcaacaactgtaagttccctagggtgacagaacagagaagagaggttggttgtcaccacccagaagtttggagaatgtgcctcagagctggggttcaggtccctggtaagaaggagtcacccaaccagcactgatgcttcgggagctcagaggtggagcactgcagagctgggctgaaacctgaggaggcggtgctccctggctgctgccagacctcagaggacacgcgctgaaactgctgggggactgttgaaactagaggctgcaacccactgctgctgttaatgcattgtggagttgacacttatgtgaacaagtgaaatggaaaggagattccttttctctccctgcctcccaggacacactgtttgcagaatagtaacaggaagatagctgacaaaagggatgtgtaatttacagaattccagtcctagcatcagcaagcagagtacagaagggtggatttggagttgaaagacaataggccatccgccaagtgggaaccccatatgcagagcccattttatgtgtggcaacaccaaaaattggcagtgtggagcctccaactgtgttgttggagcatagctgtcccagggtgattagcaaggtcctttacctttccttggtatttcctttttgccatctagactcctctcacatccttgtgatcagatgcaaccgctaactaccaaaatttgaagatcattgattttatttacaacagtgcctctctcaatgttcaatcaatcattctccaagaggaatcacccataatcctatgtgttgtggtggggagaaaaagctaggattaccgttctagatgtcttccttttaattggttctaccaaagaagggcagaggacatgcacatatatccaagaagagactgaagctctgggctaaaacttcatgattatggtggatttcattcattcttgctagtcacaggttgcatgaacagataaaacagagatgactggattggtgaaggaacactgttttcaagaagggtcaatgagttgagaatggtcaggactttgtgggcaaatatctagtctggaaatgcccttggaattttgtaaagccttccaaaccaaatcaggatgatgagagctcttcctactaggctgcgggttcttctgttctcattcttttcactccgataaagagaactgctctttttcctatttccctgccaccagctttgctttcctagaagatgaagaagtgagtgatctctatgcattatccactgatttatttttcatgcactgtggttcatgtttccagtaaacgttttcattttacaacaagaaaaatgtagccagttcctcagtaaaatgttacttgtatattagttgagcacttttggtttattaatgagtgcaataatgaaagtgtgggttgttgaaaagaatcaatgggtgtttttatttaaggcaaagcagaaatggtacaatgcttgtgaatacatcattgtcactgaaggcctgactcgtacaaacttgcctctgattggtttaaatcaaataggtccaagcacttcataaaaatgtctttgtcagccgggttttgcttccaaatctattcatctctgtcagtttttaatattagtaccaggctcctggccatagtccattagtactgtacttaattgctcatgttacagatgattaccaatataaaaagcattaatgttttcccatcgcaaggctgttgctatgtagatgtctcaaactcagcaaagcttatgaaatgtggttattctggacatttcttgctcaggatttatagatgaagttactgtagcttttgatgcaaagaaaaatacccacctcattctttctaagtggaacattttctttcttgtctaactctttacttaaaagtaaccagttcactttatttttatcagtaaaggaacaaaaaggaaaacgactacttttatggaattctcttagcttgattttctggaatagtaaatcactttaaaggctttgttttcacatgcagatttccctttttaaaaaatgtttttaaagtccatgcagggggaaaaaaatctttactcagaatgctagattactggttttaattttcctgaataaattacatggtctgtttctgtggagcacatgaagttgttattagggattttaaaaggagcattaaagcaaaagtactttatgatgtgcatttttgagtatttagaaaatcaaaatcataaacaaatgtatttgtttgtgagggaaattagcaactattcttcatcttcttgcacacataatgcctaatttcaaatccaaccttttgcttttaccataagcattccttggacaagattgtcaccctgcatggctgaggcagctttctttgcagggacttaaggtgagctgtacccaagccagatgtacttgggcagatactgggtgatagctggagcttctgccttttttctctgaaggtataaggtagagtgtgggaggcttcatgttttgaataagataagcatgtgctttaagttaaggaccaaaaatatatcaggttctaaggaacccacctaatcataccatggataaaggctggggaaggaaaggtgagttacagttctgtgcacatcaaggacatgattccatgtattcttgctcatttggacacccttggagttaatagatacgcaattcagaaagtcacaggccacatctcagaattgtatatttaagaggacccctagcaactccctagaccagtgctactcaaatgagattttctgacttgtccatgaactgttttctactagcccataacaagctaataagcacagcaattgcgaataagcattgatacacttacgctgaaatttgccagaataacattatgtctgttgaagctaataaaaacttggggcttgtgttttgtatgcctccttttgaattccatttttctagtaattcatttttatggttgtttacaaaagcatcagtcagcatcagatgggaaatttagaaaactcgtctttcacccaggtcagtggagaaggtccgctcctacatcttggccacaaactcagatatttatggaggcaggtagcaaagatgagtgcaggggccacggctggaaagtgtgaaactggcacgcacagcccgggccagagagcccaaagggaccagcccacactgttgctgtaggtagatgccgtctgtgcgcttcctgaccttctatgttttcaagatatttttttaatgtgaaataacctaacttacaaacactggctccaatatttaaaaaaatattttatataagctaaatcaaacatgcccaggggcaaaatatagcctacaggatgccaagttccacaaagactgaaatatgcttgacactaggctctccagcctctgatacagcgccctgcagtgggagggcctagaggaagcttcagggttccaggcgctcttactctgctctacacactcttccgtgtgctgagcaaaacaccctctgtggcttcccattgaccttgccttgccttcggaggacgactcgccacatgtctgctccctttgctctgatcagcgtccaggagcttgtcaaagctcctctttcacttcaggtcttcctgttccattcaaccaagcctcagagcgtcagtaatggaccttcaccagctcggcttgctctcatgcaggcgcctccagtttgtgtcactcagaatacccaaagctactccagatgtggcatgtagtatttctcaggatgcgggcagtgtcagtctatcaacacagcctaagattacatttggaatgggcaagaagccctctcctactggcctgttgcattttcttggataggatagatttgccatttgattaactgtcttttttatttactgctgccctcaaaacccaatcggtgttttttggacatctgccatgtgcagagagcactctcaggggtaatgagaacatataaagcaaagagttgagaattggctggcaaacaatgaggaggtacccttgccaccacattcatagctgagattgctaaaggaacaggatgctgcttccggtgagcccgggttcagcctcagaattcttctcagtatggcatccccagggagccaccacgactcattagaactggaagatgccatgatccttggtttatctaacccatcacaagatctgagtcaaaggccgtacacacatggaagagagttatatctatgtctgtggtgggcatggtggctcacgcctataatcccagcactttgggaggccgaggcgggcagatgacttgagacccaggagttcgaaaccagcctggccaacatggtaaaaccctgcctctactaaaaaatacaacaattagctggggctggtggcacacacctgtaatcctgactactcagatgtctgaggcacgagaatcacgggatgaatcacgggatggctgaatatgggaagtggagggttgcagtgagccgagatcacgccaccgcactccggtctgggctacagagcgagactctgtctcaaaaaaaaaaaaaaaaactacatctataaaaactagttttatgtaattaaaaaaaataagttcaacagggatcaaagaaggaagagagaaatttcaactgaaatgagcaaagtcccctctggaaaatgtgtataaaaaggtaggggctgtcaggaaagtcctaaggctgaatttccaagtcacataccccaaaggcaggtagtgtagtttatcctctcatgtctatgaactattatcctaaggtgcggtgggtagactctgcccatcctcatccatggtaaggttacccagtcaatggacttgcatttcctttcccaacactgtctttctcatggcagtcctgacctgtggcccctattgggcttacctctgcaacacggccaccctgccactctcatctccctaaacccacagagggcatcctagccctatcaacaaccagaagcccaggaaactgaaaacaagttgcccagagttaggctgactgaggttgtacagcttctcttccatctacactccaccaagcttgttcttacagggctctgagtcagttcaatgcaaacaccctacacccagagtagcttcatcttgtcatctgtaaagaatttctctccaaaggacagtcaggtaatttcatacacaagagccgcatagtctgtatcactcagcatgcctaaaatgctctgataactttccaatgcctggatatttcaagaaacttttagaaaggaaaacaaaactctagccagaccctggagtagaaaaactggtttctattttaaaaaaataaacaacagcctttgaaaaaaatctctatttaaaaattcttaaatttgcctctaaatgcaagttgtaattaatagaagttagagtttacactgttgagtgtaaaaacaccctcaggcacaaactaatcaagtgtgtatgtcatgctgtaaactacagcgagttctttgtttgaccccccccaaaaaaaaagcttgccaaacagcagtttttctttgtcgagctcctttattgtctcatttttgtttttatcctacttcctctgtcccatcctttgaacctaactatagtatttaagaaaccttgcaggtcccatgttttattgatagttttcatcaagcatgaatttaaatttgagaatagattaggtgtcttagcccttttctttttgataaataacaaaaggtttctacttgtgattttctgtcctcagggttttatcattaagattaaataactgtactctcaagcatgccactgcacaaacatcttttcagttatgtgagtaacagatgccttcacaaaggaactattgaaaattcagaaagcatgtttccaaaaaagaaaagggaaaaaaagtatcatatgacagaagaatgtaattgtttaccattaaagtatattcttaactcttccactgaaaacctcttggaacattttgtttttgtgtaagttactacaaagtttgaccaaaataataaatgttgtgggagaactgttgaacatttcagaagttctggaaccagtaggatctaacatgcatggggcttaaatgcaatagttgtttgcctatttttatattttgacactggcttccatcatttgtggggtacacatcacattgaaaacactgccatgttggctgggcatagtggcttaccctgtaatcccagcactttgggaggccgaggtgggtggattgcttgtacccaggagtttgagaccaccctgggcaacatggtgataccctatctctactaaaaataaaaaaaatagccacgtgcagtgacgcatacctgtagtcccatctattcagggagttgaggtgggaagatcatctgagtccaggaagttaaggctgcagtaagccgtgattgcatgagaccctgtctcaaaacaaaacagtattgggtttattattcttgaaataatgttcatctgcccttgaaatggatccatacaactcaattctgaagtcattgggcttttttcattgagaagagtcattgctgcagttgttgctggctggcattgtagagggctaggcaccatgcatggtctgtgttcactgtaataagcatgcattttaatccctgggacataacatcagccttccttaagtccattccaactttcttcaatgtggttgtcatttgaaaggcataggaacaacattagtctagatgctcttacatgtggcatggagacatcatagaaagccccaaaggagctttattagggagaccatgggaagcttgggcttggtaagattaagtcctagaggctggaattcatggaggatatgattctcaagtttctcttaccatccgatattaagttgggcatgatccaactagtatcactaccttttgaagagctatggcatggttattgtagcatattgtaagagtagttgcccagtgcccaagccatagggcttcttctgatgtaggaggttgaccctttgtggaatggctacatatgtattttataggcctgttgcctctgagaaaaggagaatgctcactccagtttctcaggtaactccttaggagctaggaattcacttaacccaggcaggagtgatctttcagtatctcctccgtgttggtatgtctccgtgttgatacatctgtgtatgaagatgcacagccacctttttgagatgaagatagctggactagcagaggcaggcagtttggtggtcgaactcaaaattttgacactaaatagctgtgtgccattgactagtcacttaatcgtttagctctgaacctcagttttgtcatccataaaatgagataaaataatatatctgtagatatttctttctgtaatggttgaaattaaagcatgcagagtgcctggtattaataagaatgtaatgcgtggtggtggctgttaatattgtaatgcctaatcaatatatatgaatgacctgaatgaggtttctctaccttcccaccttgcttctaacacagtcccctgaaatccatgtaactccagttcaggaaagctgtcatccttgagctaactctctcacactgacacatctttatgggagccgagccaccaccttgctgtgtccagtaccacgtacctttctttcttctcttcatttagggtcacacacactccgggaccatggagggaggtatcagaattatcagtgggcctaagaaacaactctcccacccacttccaggggcaaatggagagagcattaaagccttcaaaaagttttcttgtccatctgctgcccattgagtaggtaatgaagcccctgtgagcagatcattttcccagaaaagagaccttttgtggtgacaaatggttatatttcatcgttgttaatagtggactccataccttttaggtgtcttagcatagaatacaggtgatgctagttatacctacctcatttttaaagtatgtaaggcagtttggctttggtagctcttgggcaaactgagtctttcacacagactctgtgttgcactctgccgccattttgttggctcagatgggccccgctataggctcgttcttcatgtcagcgtggcttcttactccgtggtttggtgccccagactttcagttcacatccttgcctgttgggaggtgacactggaggcctctttctcacctgtcttggttatggggagagcttgtcacactcggcacactattttttctgctccactcaagttcacaccataaaatggagatcttctgtggctcacatctctctcagatggagcttagcttttactgtgctcaaccagggttgtgcccgctgaggaaacattctcatttctctgctcatttacatagcacatttgtgtatttggctgttgatttggttccctacccccaaaagctcttcttccacttttatggtcatggtctagcacctgagaggtgaacagtatgtgagattagaaaaactctctatgcttattggaactgtaacaagcatgtgtacctcatcttcagaaaggaaaaatataccttctattggctccatatttggtgaaagattccttcccatacttcacagtaaagttatattttaatttctggctgcaaagggaaatgtctggccaagctgtagaaatttatcaaggctggaatcaactcagaggtgtaatgactccatttggggtgagatcaggtctgaagtcccagttgaaccaatatgtcatttcgttgttactacaaaaaaaaagcctaatagtattagaatagtagtgccttttttttttctttttttgagacagagtctcactctgtcacccaggctggagtgcagtggcatgatctcggctcacttcagcttctgccactggggttcaagcaattctcctgcctcagtttcccaagtggctgggattacaggcacgtaccaccatgcctggctaattattgtatttttagtagagatgggctggtctcgaactcctgaccccaagtgatccgactgcctccgcctgccaaagtgctgggattacaggcgtgagctaccacacttggccagtagtggcatctttgacctgacatgcaccaatgttatttccctctgcccctagaaaatattctgctccaaggacaccagcaaacctttaggtctggaatttctcactgatttgataccataaagtgcctatgcagtaactggggtgactttgggattcaaatacaaccctaaaagttcaccacttcttgcccccactctctggattcaatcagttccagacattattgtaataccatttttcaagctctgtaaatagatggattctcgtttttcctattaagcactgtttgctaaatattttggcccaaaagttcagtcattccatgcaagcattaatcaatacaggagacattagtggttactggttcagatgagatttgacattatttttcctctgcttctgaggaagggaggggaatgttgtgtaataaagatgaagggtcttttcttcttttgtacaaaatgcaaatgatgaggacatgtgtgatacacacttctctaatgcaaggctgctggtttttgttgagaaagagaggcaaggccctggaggattttagactttgtaaatataaaattatctgccttagtgtttaaaaaaataataaaagggagaaagagttggcaggttgccagattacttacattacagtaatagatttgctgacccctgacttctgctgtagagaaatgtattgaatttttcataatatcagatgaggcagatctaaaaacctagtgtactaagcaccattatttaacttgagatttagcaaagccgaaatcttttcaaaccagcaatttcatgtatgatgataatttagtggctcagatgctaacaaatcaaggttataatgctattgacttgttaattttaacttgggttgattttaagtctttttttttttaagaaagaagaatgaggaggggaaaaaatcttgcttttcacagtgactgaatttaataagaatctccgtgatagcaaaaggcccccctactgtttctgctttggggtggaaaatgttattcttgtattattcctagggaaaaataaaatctcatgctgctacaaatcttatgcctatggaaagatgttattttttaatacataatggcttacctatttcagatccattaatcgcatcgtaaataagcattttgctaatctgaaatgtgaaatctggataataataaaggcccatttatctgtccagctttcaatccccagactagatgtagatcaggaaggggaaaatctctggattttctaatgaatatattgcttctcttccccattacttccacccacctaaaagccagcccccattcttagagttgcagtccattgaaaatatttctcctgtgtaatgaattcttgggggctggagtgcatgtttgcttttatctgtacagtttagaaactgataaaatctttgctgtgctacaaatatttgagaaataatcaacctcaaggcgcaggcatggtgcattttactaaattctttatataatacaaacctactcagctttctacatagggcaatgttgacctaatctaaggctaacctgtttttaatggtaccacatgtacgttgaacgtttaaatgttcagaaacctataatagcttttgtcctcttgtactgtaaaaacttctaataatcatatgataagatcatatcctgtggggtaattgtgttgtaccatgacaggataactgaaaaaacattcagtgaaaattgcaccaaacggaaatcactatatgaagcagcgattgtgtgccgtgcgagaccgtgccctgttcttcaaagcttagctggtcatatttctacttgcttccttttagcttctgccttgcttgttttattttaggaggcttttttccccaagccactataattatctttcaatgatttagaagggggggaaaaaacactcggttgacctttacacacacacacacactctctcacacactcacacactctcatatactctctctggaagccttgaacaagtagggcttgtgtttggattcagttttaccttagtcatgcctctttccagatacaagaaacatttaattccagatttcctgcttctggctttaggcctttgaccagcaaagtgaaatgtattttttactgctgtcagccagccagctgctgagttgagtgaaggggagaaaaaaaaaaaaaaatgaaagaaaaaatgaaaaaaaaaaaaaaggaaccgaaatgagaatggtgccctactttgtgaacttgcaaaattagaaaaggaaattaaagtctccttagcacccatctagagagccaggttggcccagggctctcagaacccagagtgaggggtccttgggcgtccatggggtgtctctcccacccaattctctgctttccctcctcctccttcccacactcagaggtaatgctgtcattcttctcagtaaagagggtccctcgtggtgtcaccatctccatcagaaaatgaagctgggggaagggtggtaccagcaaattgctatcattggaatacccagactacagtgttccttgagttcccatggcaacaaaacaaaagtaaaacaaacctatctgtcccaacaataaaatatgtttccattaaagtcaatttaaaatatctttccagtttaaaatattcaatgcattttgctcccagacaaaaatccacaacctgccaatattgaagaggataaagtccctggcagaaccaggcagaaaaaaggaattggggggaatgttggggactttacagatgagacagaataaattcaagtatgaacaggattgcttttttctctttgtgcttagttatgctttttattatataaacattaactgtaatattacagtgggaagcaggtatttggcagccatatattattttagtaagtctacatagggagggcagtttccagttttagcagctgtaacatgtttaaactcagtttgtaatgggatctgaagataactattccccatgggctctgttgatcttcatggctggccaactgccagatgtagggctccaaagtattattcacgcctccttgctcataccttgtccaagcatgctcagtaaatgaattttgtttctaatatgctataaattgggatctgattttcccatagttttattggtattttattaaagagcaaaatattaggatcacaaatgtccccacatccgtactgtcaaacctgaacaatcgtgtatggttaagcagttgagatccaaataacatagatagaaaccaattttaggatagcaaaccaatatccagaccaaggaagtttttgcctgggaatcttagtttaaaaataatcaggatccccaatatttgaacagacttatgatgtttataagccaagtacattttcttcattgagtcaacttgtcttatttaaaacaaattatgtttgctgtattaaagttcatatttttaaggctgagtcttatattaatcccacagtgagtcattaatcataccaaatgcattataaaaactttaatcactgaagttgaaactgagattgtaatgcaatccatcccttttaattacatcagctatttttccctttcagataaagagctacgtcgcaaagggaaaacagattaaaactagagctgtttgatgtttctctttttagagcaattttatgcagtttgtttaaaaagttatataatttaaatgcttgaaattttcaggcctctggtttttgtggcttgcatagtctgtctgccttccttctcgctggggcggtcttttacttagcacactaaaacagaactcctagtggagtcccctaccccactcagagctgtgggataagactaaactgtctcttggccacgctgtgcttgcctctcattgacctttttatcttagatgtttcatctctatcttgacatgaatgaaaataaaatgttttcagatgggcagcactaggttcagatctcacctctaacaaatggtatgactcaggcaaattgtttaacctttataggcctcaattgcctcatatgttaaaaaagagaataataataatactccatagggatattgtggagtttacataaaataatctttaaatgtacctggcacatgctagtacctactagaatataagcttcatgagctcagaggctttgaatgtttggttcatggctgtgtctcagtgcctagaacactgcctatagtatgtgctcaataaatagttgttgatggactggtaaagcagctagcattattgttgcagttttgttagcacttagccaggtgccatggggagtgatggtgatattgttaatgttggatgcttccattggtatcttggtctatagacccacaaaaccaaaaagaggtcttgctgagaagtattaagttaccaggtactgattttgaccaaggaagcagaacactaaagtgtagagtaagtttatagaagtatagcactgtcactggagatgaagtcatttaataatttgcttatattgagaaaagaaagtaaacccccatagcattgatgctactggaattactcaactgaccgatcatctcttctgttaaccttttagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtgagttgctttgctccatagaaatacctctggaagacatgtgctgcctcgaggtccttctggagccctgaatccacagctgtgtccctgcacagttggatggcttgatgaagaaaccaagaaatctaagcttcacagttccccacatagttccccagttcctgaaagcctttcagcttgctcatgagatgaaatccaatgcctagtattgaatgagatagcccaggaatagaatctagaaagatacaaacatcctgtagaaaactgatagcaaatgctcaggcttcaagagaaaagggtccagagccacactaacatcaaagaattttactgtgaaaacatggcttcttggccgctccacagcccgtctatctgaggtgctggtgcgactttaaaacatattttggggctggacatggtggctcgcgcctgtaatcctagcactctgggaggccaaggcaggtggattgcttgagcccaggaattcaagaagagcgtgggcaacatggtgagacccagtctctacaaacaaagctcacacctgtaatcccagcactttgggaggctgaggcgggcggatcacaaggtcaggagatggagaccatcctggctaacacggtgaaaccccgtctctactaaaaatacaaaaaattagccaggtgtggtggtgggcgcctgtagtcccggctacttgggaggccaaggcaggagaatggcatgaacctgggaggcagagcttgcagtgagctgagatcacgacagcctgggtgacagagcaagactccatctcaaaaaaaaaaaaaaaaaaaaaatatcaggcatggtggtgccccgctgtggtcccagctactcaagaggctgaggtgggaggataaccagagccctgggaggtaaagtctgcagtgagctgtgattataccactgcactcctgcctgggtgacagagtgaagccgtgtctcaaaaaaaatgctttggaggtccaggaaaggggaccttggaactgtggtgctgtatcctgcaagactctcctgaaaactttagagaagtgtttgtctcccataattgatttctgtgcaacagccatgggttgagaccaatttaagaaaatcttaagtgtggccgggcgcggtggctcacgcctgtaatcccagcattttgggaggccgaggcggtggatcacgaggtcaggagatcgagagcatcctggctaatacggtaaaaccccgtctctactaaaaatacaaaaaattagccaggcgtggtggtgggcacctgtagtcccagctactcaggaggctgaggcaggagaatggcgtgaacccaggaggcggagcttgcagtgagccgagatcaggccactgcactccagcctgggtgacagagagagactctatctcaaaaaaaaaaaaaaaaaaaaggaaaaaagatcttaagtgcatattatttataggggaattttgaaatggttcctatgaaaccattattatttttcatattaacaggtagtttctgcactttttaagcccccaacagccttttggtagaagccattacccccagcatgtagccagtcatgtaggctgatctgggctccatttcaacatgaataataaaaaacgctgctgcccattaaaaaaaaaaaaaaactgagcagccacatttggagacagcatgttctaggattcaaccccagagggaattttgatgctgatattaaataccccctaaaaaatcaggtttataatgaacacataagaggctccataattaaacactggtttaaattgcacatgtacaacacgcaccaacctcccatctagacatcaacttacccagctgactcttacataagaaaatagtattgataccaagattagaaatttgtgggttttttgtttttattaggtttcataattattttaagctctagtaactaaaaagggggaggaggaagaagatgatgcagattttttttttttttgagacagagtctctctctgtctcccaggctagagtgcagtggtgcaatctcggttcattgcaacctccgcctcccaggttcaagcaattctcctgcctcagcctcccgagtagctaggactacaggcatgcaccaccacacccggttaatatttttgtatctttagtagagacagggtttcaccatgttggtcaggctggtcttgaactcctgacctcaaatgatcctcctgccttggcctcccaacgtgctgagattacaggtgtgagccaccgtccctggccagatgatgcagatttctcaacatctgcaagcttgcaacataaatggccaaaagcaaggaaattccaagtgcatgcttacattccatttttccttgatacttttggcctggtgatttattatagggtttcagatgagtgtgttctattagctgccatatgtacacaaaacaccaggggacaaactgaggaccaaggggacagctgaccgttgaatatctccaatttggggattaagtttgaaatggttggtttgtgaatggtaggaggaatctttagcctatgcactgagcctgtcagcttggatgatgaccatgcccaagagtggagccttactccctggagtccatagaaaccctgaaagctgttaggctttgtgtttcctgtaggctgcaactgttcccttcagggagctgtaagtgtctcaggttttgaaagttgtcatgatgaggttatctaaacctcatggaatcttccaccctctccaaggttgaccttataatacgaatcacttctcacctccaacatagaaccatgttattagccaggtgtattttttctcattaactctatttggggtttttggtttggattttattgttttcatcgcttttagtttttggtgttttcaatatgaagcggtgaactcaatggagatacaaagggtgagaaattccctctagttgaatccactatattcaagtaatgggattgcaagttgcatggtgggaagctaacatttaacatactaagcagatcataaaatgtcttactagaaaaaaagtcctttacttttttctgcctagctttcaaagacttcctaaacctgttttacaacccgaagcatgggactctgatataactgcagttctacatcatagaaacttcaatgagactgagtatccctcattgccctgcgtcaaactatagccccataagaaactaacaattagatgcaatttgcctttttcccttgccatactcatttgtctttatttttgtgtcatgtataagctcaagagaccaatgtgatgattattaatgtagaagaagtaatgatatttgtactggaaaaggcagctactagtacaaaaaataaaaagaaataatgatgataagcaaagtctcttaggtataacatgtccctaaaattcagggttttttttttaaagggatttaaggaaaaatacctgtgaaataggtgtgatttcttaaaacttttgttcccacgtattcctaaaccagcatcctcaatcttacccaaagatgctaattggcagacccacccttccttccttcctgcctgcctgccttccttccttcctttcttccttccttccttccctccctccttccttctttttcttttttttttttttttttgtgaaagttacactcttgttgcccaagctatagtgcaatggcatgatctcggctcaccgcatcctccacctctggggttcaagcgattctcctgcctcagcctcctgagtagctgggattacaggcacccaccaccacacctggctaatttttgtttttttactagagatgaggttttgccatgttgaccaggctggtcttgaactcctgacctcaggtgatctgcctgcctcggcctccctaagtgctgagattacaggcacatcttttcttaacagagaagaacaaagttcaagggatgagatggaaaaaggaggggaagaataccagctcagtacaactgttttgtgactgctctgctaagacatgtcagggcagaatgacagcagttttgaaagggcttgtcagtcagctgggtcatagatggaaagttaaaatgacctcctaaggtcaaagtttatatggctgcataatgcagtaaatgagtcgaattggtacccacaacttctgtcagtagggtcacataaggagtgtgtctgtctcattgactataatttatttcattcaacagcaaagctatatttgcggtggcactgactgtctgaattttgacaacttcattttgggctttaatagaaatgtagtttgctgcaacctagaaggacttagtctcctctgtccctctggtagacaggctgccaagaaatcttcatactttgtcaatattttagcattatctgcatatcatctggccctgagtagaaattattaacacttatgcattgctaatcttcagtgcatcatattgaatacattgggaagggatttgccctgttaaggaaagcagggagttgcaataggtttgttgtttgtcgttaacatggggttggttggatttttgaaagagaaatgctttaaaaaaatctttctcaggagtatcataaaacacaacatgtaatttaaaacccatttggataattgactgatttgacaagaagacaaccttagaattaaactatatattagaatcaaggagtgatatgattgtataccatcagtacataatactttgctattttgataggtatctcataagggactgaagcgaatatgcatatttcccctaatgtttctgtaatttagatttctttgtttagagccatgattggggagtaataaagctttacagaaacttcacgagctgattgacaagcctgttttcaagtaaaactgctgtgtggaatattttatttcatagcaaaacatgtctgtgtatttggttttcttctgactgtcttttgaaatatgttaccaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtttc

SEQ ID NO: 197 - DNA, 80273 bp, Homo sapiens
ggcgcatgcgccacggtggccgacttgaaccgaggcttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacggtgagtttggtacttgggaaatctgcggtcggccagccaccttttgtagcacagaaggtctaaggaatttttaaaaaggaggggaaaggagagggaccgaactttttttttcctttctgttgctaacggaggcgatggtgatggtggtggtggttgtgggagatgcagtgatccaggattagaagtcgcatcgtttgcaaggcattaaacaggagcgcgagtgcacgaaggtagccttaggtaacgcgccagacccggtctatcttttattgtcagtgagagatgctgcagcgtcggcccgcggggtgcaagcaaatggatgccagattgaatatgcatgcctggagctcggatattgttctctgggctgcgtgctgcgaggctggactcctccagcagcgatggggagatggggacttggatcctccccgggtcttccgcccccacccaaaaagggctttctggagccttctccgggtccttggaaaaaggagcgggtttgagccctaaggcgtaatgacagcagagggatgctgaaaagggcagggtgtaccggaatggtgtggaaacgggaaggaaaaacagggacgaggtgatgagcagaggaggaaggcggggggcaaggcgggggcttcttgttggccaggaaccggttttgggtgccccccccccggttttctcgccctgtagttcggggctggggccctggcggggattcgggctctttttcacgtctcttttccgccccttctgccgctcaggaggcgtccgtgttggtgcatacaaagcggactgcagggtgggcgcggggaccgcggcgagcggccgggcgctaatggcgctgcgcgacgcgggagcagatggcccggccccggccagacaatgatcgcggcggccggagggctcggcgcagtgctggggcctggacttgttggtttgcaaaccacggggaaaacgtctgtgccgtgaattagcgatgcctcagagatcagcaccagtcttgctcccacctctcccctgctccctccctctccccatcttttcctggaaaaattcgttcgtcctattctttccatccccagtgaaatcccagggaggggggaacaccagggaaattcattgttatataaggatgtgcaattgcaaccggccagctgattcccgggtagaacctaggactgaggcagagatcgaaagagccttttaaagcagtcaggatgtgtttttagggctggatataaggacgctctttggttctggttttccctttagccatgggcaccccggcttcctctccgtgcacaagggcacacccatccgcgggagagagaaggggagcaaatgcataggggagggggcgtgtgctcggaggattttctaggatgatctgaagaagggcgctagcttcttcttgaaggcaaaagacccaagatcccaaagggccgggcacggggcacccacccttgtgtgttcactgtgcaggaggaaggagtggtgactctggggagggaggatggaaagcagatttgcagcaagcctcaaataatttgctgtcttcgtgaatgaacaaggcagcttcattttgacagtgtggggagaaaaaaaaattaaaagcaaacgatcaacaagacttttttttttttttttttttttaaagagcgcccccccccccacaccctttaaaaaatctggttgcattatcataggacctatagcatggtattcctccctccctcaccactggcagcctcttatgtaagagccttctggaaggcactagagtgaacgggggtgtggtgtttcactttttttcatggcatcatgttggctcgggatattcgcggtgatggctggggcaggtaccacagtgactgtggaggcaggaggtgaagggggaggcctctccttgccttccaggtgatatttattccatggaagcttagagatctgggagagaagtggaggtcattgtagacagaggacaagtgcactgatttgagtgacctgggcaagtggcctaacctctctgagcctcagtttccttatgtgtcatgggaatagaacctggcctcatctacctcacagatttctttcgaggctctgatgtcatgatgtgcacggctttgtaaaggtctttacacttaccttatacaggtgcaggaattattgttggctattctcctttgactttccaaagtctacgtgaggatcagggaccctgcagtgtacaaaattaaaatgatcttattggttttcagtatgttagagagacaataaatactttctgaaccaaggtgtgtgtatttatgtgtaaaattatcttttttccttgctctctagtagcttatctcttttttaaagattttctatgatttccttttcttggtagctgctaaagagaggtagcacttgctgagaatattgttttgtaactgaattttgagttaactattgccaaaagaatgtcattctttgaaatgtgttgcatattaaaagggcaatgtatggttcagcttgccaggtttaagcccattctgtataatacaggtgcatatttactgaacactcgatgccagcattccttccatcagcagcatttgcaataacgatgagtcataatgtagcatttctgtcacattctcagactttatctgctgcttgtcctttattttttagcataaatatcaccggttaaaatataagtgcatcagcaatctgtagtgcattgcatcttagaatttgctatctcagatacttattcgtgggagtttacctttttcttaacagcctagttaaaatggcatcaatggcgtattttttgtagtctttttgctatacttgctgtgatttacctcaaagataaatgcaaatataaaggacatattgaatggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgtttttaaattgaggtttagccaaaagccattttaaaaagtactatcttctttttttttttttgagttggagtcttgctgtgtaacccaggctggggtgcagtgacgtgatctcggttcactacaacctccgcctgctgcttcaagcaattctcctgcctcagcctcccgagtagctgggattacaggcgcccaccaccatgcccagcccattttttgtattttttatagagatggggtttcaccatgttggccaggctggtctcaaactcctgacctcaggtgatccgcccatcttggcctcccaaagtgctgggattacaggcatgagccaccgtgcccggccctatcttctttatatgaaataattttcactgctttttttttttctttggagtccaaggtctaattgaaagagatggttcgtttatctaggataagctgtccctgtgtgttctgactcatcaggtgatgaataggttgccacatacaggcttacctttgtcactgaacctttccaaaatgggcttattttgaacatcacttttgaacagtgaaaatgtatccttagctcacatatcttagcacctgtttctcataggtcagttacgcgttgtgaccttactgcctctttgtttcagagcgatcgtcttctgatcaaaggaggtaaaattgttaatgatgaccagtcgttctatgcagacatatacatggaagatgggttgatcaagtaagtgtaactcatgatatacagatgtatttgaacactttccagacttcccaagtattagataccattcgcatccaaagtatcaaacttcaggaacatcagagagtgaccaacttagtatctgttttaaactggttttgattggtggtaattagtgaatttgaaaactcaaatttagggaattcaaagcaacaattaatgtacacccgttgcattaggtattatgtaatttactatttttaactgaggtgatatgatatctttctgttgccagctcaaatacttggtttgtgatatgttgaatatattaaagttttgcctagaatgtcattgtttgggttggattgcccaaaggacgcaaacgtgaaagacagtctcctctattgagacagcacatctgctttcttcatcaagaatccaagttggaggggccaaagaaagataccaagttaattactaagtaatacagacaaattactgcctaaatcctgagggaattttaggttttattctaagtggcaactagtgcaaataagactgcccttgtgtttattgtgttaatgttacaaaggagaagcaacagggcagttcctgagtttgggtatttttggacgccagagggttaaggaagctgagttcatcccagtatctgcctgccctttctactggggtagctcccggggctctggagaaatagcacatctgtttgaagacaaacactgcagccagtgacagcttttaaataagcagcattcatcaagggatagctgtaaaccggtccagaggagtggaaaactggagtggctgtgactgttgcctgggagctcacacccagatttatgaacctaaaatagattttaacatttccacgtttaatgttttctccatgtgtgtttgctgtgacagtctcagctccaggctctcaaatgccatgactttgatgttccattttcccccaattataagatggcacgatctggtctggtagaatgacactggcccagaagtgtgcaggcctgtgtgctgtttttactcatcactgatttgttctagaactttatcaacttctcctagattaatattccttttaaaaaattggtagaaagatataaaaatattttttaaaagttggaaatgaatcatgtctcccaacataatgaatattcatttttctgccttttaaaattatatttcagctgttagctttttcattatctgaataactaaacacacgcttccaaaattttaaatcattgcaatcatagtgttcactttttttttttttttgctttgatttgttctacctcacccttccacccctattttccttctggtgaaaaggatatgataaaaataaatgtttggaaagtacggccaggtctggagaaaattgctataggataattagctcaattgcaagtgctgtaaagaaagtttaatgacagttcttagaaatatcttggggccttgttatcatttgatcttagggggtttcttgggaacaaaacgtctttgagtggggcctctggtgccttatttaacttttgctttctagtatactctgcattgcctcttgctggggggtaggagtatatagtgttttattatgaatcgtaacaatgatctgaaaagcccacggcacagagcggaggatagtttataggttagtgaaagtagctgtcagatcccatttgagtccacatttcatttacaacccttatcaccaaccctgtttatttaggcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcagtaagaagcttaaaaatcatcattgtagtgcttaggaagtgtgagagtttgcaaataagtctattgtttgattctctccttctaaaacttgctgtcctgagccacagttcaatctaccaaataagggggtgaggatgtgttaaccatttgtcttatttatttatgctcattttctgtcaaattttaagttctcccattgaactagagaatatggttctaaggagtttggtaagatgaatgacttcttgctttctctccatgtggacttttgtcttccttgaccctagaatgtgatttggttttgaaaacacggcatttgaagtcatcttcaatgccaccaactttaagccattgagcataagtatttgattgagattttcagaaaaattcctaagagtgcttctttttagaatgaggatgggctgcaacaaatgaaatgctgaagcaggaactcctgttcctctgatatgaaaatcaaatggagacgatactctctaggctgagtttaacataaaaggaattgggcagccctgtctggagggggacccacaggtaattgtcttttagatatgaaaattgctgacacccacagctgggtgccccttacgtattgctccaagggctttgtgctttttttttttttttttttttttgagacagagtttctctcttgttgcccaggctggagtgcaatggtgcaatctgggctcactgcaacctctgcctccccggttcaagtgattctcctggctcagccacccgagtagccgggactacaggcatgcacccccacgcttggctaattttgtatttttagtagagacgggggtcttccatgttagtcaggctggtctcgaactccccacctcaggtgatctgcctgcctcggcctcccaaagtgctgggattacaggcatgagccaccgtgcctggccgctttgtgctttttgtttaactaaatctgaactgtattcacagcactgtgacacagcacacataatattaagagtttgcttgtgaactgctagattccagcatgcccactgattgtccttttgaaaaatgtcattttgtttttgaggaggtgggcaagctgcatagtggcccgtcagatacatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttgccccgcattttaaatcacaactcatcctctggcgttctctctgtcctggccctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtcatttgctggggaatcactggcacctgtgggcgtttctgcctctcctccagggcggactgtggagaaacacttgaacttggagaagcttagactattcgggtgtcagccgggaaggccaagtcagggtgatcatctgcctcagtttggagttcacagggagaccctgcaggcccctggattggtcacagacagtcaataagccattaaaaacaatatttctctggctgggcaccatggttcatgcctgtaattccagcactttgggagcctgaggtgggtggatcacttgaggtcaggaatttgagactagcctggccaatatggcgaatctactacaaatacaaaaattagctaggcatggtggcatgctcctggagtcccagctacttgggaggctgaggcaggagaatctttgaacctgggaggcggaggttgcagggagctgagattgcaccactgcactctatcctgagcaatagagtgagactccgtctcaaaaaaaaacaaacaaaaaaattctcgagtgaatggtcagtgtcatctatcattggagagggaaatgcccccagccaggagttaggagtctggagtgctggcccccttctgacactgacttgccgtgtgaccttgagtcactaccctactctgtgttctagctgtgtgtctccagtgagggatttgtgctacatgaccctggaagtcctttccagccccctacatttggccattcactgaaactcattcactgaaactcagagagattttgcctctcatcaagtacatgttgctcagcagatacagaaagtccctgttttctctcacacttgctggaaagaatccctcagcccaccatctcctgtcctgcattcctgggtctgcctcttccctccacacgctcgccccgtgcttaggcccccactcttgttcttgtttttgactctttcctgccttcccttccccaccacaggagcatcaccttcttgccaccaccccgaatttctctttcgtcttccccctcagaggctgtggccttttttccattcatccagatgggttccttctgtttagggacgagggacatccccctctgagtgcagcacctggcccagggagctcagaagagtcagcagatggccttatgggcaggtggtccggaaaggggagtgaggagtctgaccgcctgctctgcttccttggccagaatgctatggcatttgcacggaggctgtgtgatgcgatctggctatagagtggggcatccaatgagcgaacctcaaggaataaaagtcatcagagggggcagtgtatggttagcattgtgacccccaaatgccattgcttttatagcctgagaaaagtactaactacttttgcaaataaccacctatgtttactgacctctgtagaatttctactagcctgcctttccccgggggagggaatggtaataatacaggtgaggaactgaggaatttttatcctttttctgtttgctgaccagacgttctgcattgctttaagtgagtgagtggctgggatttgctttacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatctccctcttcctcccaactccccgccaccccgcccctgggcactccaccctcctggctttctggccttctccagaccatgtcaccatgtcacctgccctcacgggtaaatcctcgcctgcctccctgctggctctgcgtttcccaggtcacaggccctggagactcctttctgtctgaaatggcgccgcatgtagaggaaaacacagccaaatattctcggtttaaaaaaggagatggcatgtcagcagcagaagataatattattgccattaaacagagcctgctattgagaatcacacaatgagatctttatgaggcggactcagtgtggagcagggggaacgccctttgccctttccacccagtggtgggtgggcagagactgcagacataccctgcaggcggcatccagaccggctgaggggttgcgggggcggccgcattgctgcttggggaaaaccctacggacttcccagggccttcatggtcatttgagttcaggatctcagagtttctaggaagcagctgggaacagttacctctattttatagaggggaagactgaggccggaaggacagacacgacttgccaacacttaccctgtgcgtcggtgcaggtggccaggtgtggaacatacacctgtagctctggcctcaccgcttgccctggggccacctttgctctcagcctcagtggcctcatctgcaaaatggggcaagttttgacaaaggtggactgtggtggcatcacaacagcatctgcccagtagtgagcactcccatgtggtagctattgtcattccatccttgctgggtactgacaccctcccatctcttgtacactgagctctactctcccccgcatggccggagaaacaggctgagctgccgtagggcttgacctgagtattcactgagagcaggcgctgtctaggcgtggctggcggactgtgtgctttgtgtgttgcttctgggggcggcatcttgaaacattacacttcctgggtcccaccttacctggttaaagtagcaaatctgctggtggggtctgtgactctgtattcgaatctggtgcttggggagctttttgaaagcatgactttcaggggtgcatgccggatctgcacactctggatctccagggcttgggaaccactgctctgaatgtcatttctgctcacctgaactccaggctctctctagaggaggtgcaccctcaggcacaacatacccagcaggcttcctggtccctgggtagcaccgcacagcagagatggggactggactctagcagggaggaggaggggaggtgctgctgccgcagggctggaaggggccctccctcctgagtaccagccttgtcacttctcccctggctgtggctccctggatgtgcatcaggcacctccatccaactgtccccagttggactccctgtctgctccttgctgcttttccggtgcccagtcctggagagggctcgctggaggttgtgctggcggtatctgcagagtcatcctagcatcttcatgtcctcgtgctgccttgagttgctttcatctctgtgttacctcttgcactcattcccttacccacacagatttgacttttgtcacctcttcctggattttggccctgtcctctgaggagtcttactgtctgtcccccacctcctgcctctcgccaggctgtttttctggtgcagctttcattgtgccgccttcttcctctgaagccttcagtgactccctcttgctcagagaatcagcccaagtgtcagaaccctccacgacgcggcctattcctgctgccccagcccagacttgcattgtcatctcagccagggatgccctccctttctttccctgcttctagaagcttcatcacccttggtggcccagcctgggtgcttcccattcactgatctcctgtgatctgtggctgctgtgtggcctcttcgcaaacgttgggcttttatcccacagcccaggtggcattcagccttgcgtgtggttcaatcaaggcccctctgtctcttacattttcctatttcctgccgcctgggcagcctcactcctcagaggcactctgttaatgcccatgggtgaatgaatgagtgagtgaatgaatgaatgactgaatacactgacgatacttgatatcctgcttcctctgagtgatgccaagagacttagtgtcacaaggagggaggagggtttaggtatccgacgtggactgtgttcaccctgatggaagctgtcgcttgctcagcagtggctccctctgcagccccagctccctgagtccctgtggtcagatctggtcatggtgggggagggtggcagaaagaggaagccgagagcccaggcatggcctgtggttgtggatgggacagctccctctgtctgggctgttcttcagaagagggtgggaacagcagctctctcattggtcctcttgcgagaaagcctgctctccaagtacagagggtcacaacatggagaaatcacatggtcccagcaccacagtggacccagcagtcattcccccagtgccttgggcttgtcccggctcttcctactgagcctccccatggaggcaggagggctgggaggaaggtgaggtggcttcctgaagggacgtggctcctgaatgtcactgcggtacatccacggcttgtcatttgttcatccatgtggcatgtgggttgctccctccttatggcgagtacacacgtgtgaacgcatgcacacactgtaatatggatgtgtctgtaattgatactttgattattccctttgcagcactcatttgactcgggttagaaagtgtttacaaaaacgcccgaccacatcagacccaagtttcaaagtccaggaccaaagttgttgccacaaaatctgcctgtggcctggcgattagaaagccacgttatccaatgggccattggtgtgggctggttctctgtgctcctccccttgtcccctcagtctccacatggttgaggtcacacatttctcctaaggacacgggtgccctctgcaagcagatgccgggagcctgggtccactcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccacccccttggcatagtttgggccgatctaatgcctggcactgagcagagcggagggatctcctaatgcctggtgcggtacaggggaaggatggcggagcatcctcagagacagcacagctcttcccaaaggtccagcacgcacactttaccgaatgcttttcttgtgaagggagtcattgggttgggctagccaggtaggctgggtaggcctgtgggggttaggaacttctaggcccttccagaagcaagggcatccccaagtgggtgtctagactctgtttcgtggacattgtggcagttatcatactgtcccagggtttcttgcccccacctggccctgggagctggcagttacagtgctggaaatgagcctgactcactggggtggtgatcttccaccccttcaggtgccctcatcccagttcctactctgcctatgggtgttttacatggagagtcacagcactgggggtttcccagagcctagactctgacttgccctaaagctgggtcacacagactattgggaacttcctgtcgatcctgctggcctgattgacagctggaaccgggagtggaggtggggcccatgggaatgctaggctccagcaagttctgcctgacctttggatgtgagggtcaggcattcagtggtcgggtctcagggttccttattgctagatgaaagcttccacgacacacatgtgtctaagtgtgcccttgtcctatgtcctggctgagtgagttgggcagagacttctgaggacagcgatcgtggcctctccattttcctaaggcccctgcatgcctggagctggctgtgggggcagccagagaagctgcccaatgagtctgatgggagccagacccgttactccttctactcatgatagctttagcattgttgtcccggggcaaccctttctcatgtgaaaccttgcgtggaaccccctccacctgagatatgagactgatgaatgcagaactgctctggttggaatggtgggtggcaggtgggctgtgggggagtccagatcctctccgctttctctttgtcatccccccatggcagcccctctgcctctggagaatcccagagcttggggaagcacaggatggaaaccaacccatcctggcactgcctccccctctgcccacctcccctgcaaagcttgcaatgcgattggtcctggtgtagcctccgtgttgagttgtaggggaaagggtgtttagtaagcaggcatatacccacggagtcgcttaagaaaacacctaaccacactgtaagtttttagtagtttcgtttaatatccctctctctgttcaagacaggaaccagggtagagcacctgtttcattttccctgcctaggtttgggttggttttcttagctttttatgacagcccataataggtgagcattctgccctttttaaaaaaattaatggtgcagagagttttatttatttattttttagaaacggtgtctcactctatcacccaggctgtagtgcagtgttgcgatcatagctcactgcggctttgaacttctaggttgaaacaatcctcttgtcccagtagttgggactgtaggtgtgcaccactacacccggctaattttttacttgttagtagagatggggtcttgctatgttgcccaggctggtcatgaactcttggcctccgttgatcctcctgccttggcctcccaaagtgctgggattacaggcgtgagccactgtgcctgtttggtacattagtttttttttttttgtttttttttttttattaagacggagttttgctcttgttgcccaggctagagtgcaatggcgcagtcttggctcactgcaacctccacctcccaggtacaagccattctcctgtctcagcctctcaagtagcttggattacaggcatgcaccaacatgcccagctaattttttttgtatttagtagagatggggtttcaccatgttagtcaggctggtcacgaactcctgacctcaggtgatccacccgcctcggcctcccaaagtgctgggattacaggcatgtcccactgtgcccggccggtacattagttttaaagggaagattgactgtgggtggccaagggatttgtgttttctgacttaaccatccatggctctgaccccaagtcacccattaagggctgtttctccctttttttttcctcttcctccccaagctgacctttctctcttcttaagaagtgattactgatttctttaggttttgagggttctgtctttgactctccgtgattgttgggtgaagccatttgcttaaattccttgcttttagagcgtcttaactgccatggtaatgataaaggggagtgacagtgagtagaaattagagttctttctggttaacccatttgggaggtagctttctttgaatatgactaagtgttccccctaatgacagagaggatgttgctgggggttgggtcgcggtggctgaggctgctgtccagttaagagaattttgcaatgaactagggcagtggtttaaaaaccttgactgcacattagaatcccctggggagttgtaacaaaatgcagagaccagaccttctgacttaattgttctaggtgggcctggcattggtcgttttgaaagcctcaaggtgatagctgggattaagaatcatggatcccagtgcttgttctgatagttggacttctgttgaaaccgaatgaatgtctgccaagattttccgaaacccagagctgccctctgctccctgctttgtcctgtcctcttcacgaagggagtgggatcacactgttgctatctggccagggtggagtctacagccagatgctccccagaagcttaaccatggaggggctgagctaattgtcaccagaaagagcctcctccttcagttgctgtccttggtgttcgggaaggttttacttggctaattccctaaaagggcactggttaggacttggagtaagtggtgatgagcaagagcagggctggctggtgggacagggtgggtgccgggggcagaggggaactggaatgtggactgctgtccccagcctgtggccacctgctgtgctggtttccctgagaaaaccctactgtctttaggttgaatctgtagtgtttatgacctaatcactctctaatgataggtcaggactggaatctttccttgtggggagcctgtgagacaaaaatcaaaagggcctgataataacatagaatcatggactcttaaggcagccattcacctccttcccagccccgctcccacagctgggcacggtttattggaccaggcttcagaggatgggattgtaagtaactcaacaggacaggatgggagcgctccaagaatcagatctaagtttaacttccctttctagtgctttctgtctgagcgtgatcatcctaatgtgtttctagatggctatttccacatgtgtaaagtggagacaatcaattcttatgtcttacgactatggaaaaagtgagtttttttgtgccatactatttgaaagtaatcattgtgacacctttggaacaagtgtgaaaagatctccctctctctctctctcacacctgtctgtatccatctttatctttttatcatctatctctatctatctattaatatatatttatctatctagcatgacctgggataggtgaattctatagccaggtggcctccagaagcttacgaaatgatcgtctaccaaatctaccatctatctatttccctacctacctatcatttatctaatctatctatatattgatatatatctatctggtctatatctatcttgatatgacatctgtctgtacctatggtctatcatctctatttaatccatcgtctctatatctattgattatcacttatctgttttacttatcctaatctatcattaatctatcatctttctaatctatctgtatatatctattgtttatctaatctatcaattgaccattcatctgttcatctttcatataccaaagatgcagttgcatgccacctgattccagatgggttatctcacttcactgtcacttagtgagatcaggaagaagtctcaaggattgtttcaacttcaagcctatgtacatgagtttgcgttttgaacatagcaggaaaaacaacgatgtataagaagctttcttattggctgggcatggtgacttatgcctgtaatcccagcactttgggagattgaggtgggaggatcacttgaaggcgccaggagttcaagaccagcctgggcagcaaagtgaagccttgtctctaccaaaatcaatcaatcaatcaatcaatcaataactaaaaataaaaataaaaaattagctgggcgtggtgacacatacctgtagtcctagctgcttgggaggctgaggtaggaggattgcttgagccccagagtttgagggtgcagtgagctatgattgtgccactgcacttcagtctgggagacagtgagaccccatcttaaaaaaaaaggtataatgtagcttatagggcttataatcctgtaagaagacttcttatgcaagaaaataaaaattttacttttcgctattttttttttcctcctccaaataatctctggagaatttggagcctgattttcttgacaacacatctggccctgcagatgtaaagcagtgttcccagaaaacagcccgtcaaatcaataactcttgctatctttgaattttcagccttttttggcattcaaatgaggccaactttataagtggccattgctgtgctgttgaattcaagcccctccgtttttcatggtggattccttgcattgtctgctaggggggttgcattcctcgctgaaccagacctctgccctcttccccgctgccttgcagtttgctgagcttccaggcagggctgcagggtcgtgctgctggaagtattggtgacaaattcttccccagtgggtgtttcggctaaggaagcatttagtcatgtagggcctaccatgcccagcagtgcagcgtgggagaggcctggcagagggcagagctctcttctctccagccgggtgtggctggtggctccttcctcttttgtagtgtcaaaccaagggatagtatggacccagcagaactgaaagcaaagggaggacccattattagccagttctggcagaggcgagcagcttctttgtgtggacaggcatatctcatgcctttttgcttcagctgggagtttgttttttttttaattactgttatttatttatttagtaccttagctcattagctgcagaaatcacaggggatgaaaaagcaggtaggatgggtccatccttaaagcaaggagagagttgaatgaggaaactgtccctgaggccttgacagatattttggagctaactctgagcccagtgagggaggacctaatcttttggaggaagtgcaactttagcttcagagttttaaatggaaactgggcagaaagccacagcttgggcacagcattggtggcgtgttgttgtgtcactttgcacagttagatggggcttcagccctctttgtaggatgaacgtttaggttcttgtccaaacgaatacacttctatatcctactaaaaatgattgcaggacagcagtgcaaaccagggctgtcctaggcaaacccaggcatctgtcactctaaaggacacaaggacacgtgttgagtcctcttgtcctccagtgagctcgggaaggggatgaccctagcagttgctctctggacctctccacagacctgccgggagtcatgggtaggagttgtgtgattctgtccttttcacaagagatggttagaagaaagtgaggagtttggagggagcagataattgatatcatttatcgggaatctgtgggacgcaagccctgcatacaccatttctaatccttccatcaaccccgaagatagataggcttatcctcctgttataaatgaagtaatgagcagtccagagaagtgaaatgacttgcctgaagccacagagcctgcaagtgcgagggctgggattccaatccaagctctgggccaatggcccttgcatatcctagaatgcgagaggaacgtttgttttgtagcagttagacagcctgctcatgaaagctgctttgtgcccagccttgtgacaggtgctttacaacaatcccagacacagcacccaccttgagtttgccctcaggtacagggctcctatccatcctggaagaacagaaagattttggtgttcaagttttatcctgcccttccatccacctgttatttaaaagtactttttctgtaatatataggcagaaaatgatcagatatcatacgtctcctactaagtgggaggctgcacccagcatggaagatgctcaccaagacggtggtatattgggtgtctcttctctcctacagaagccctgggttgatgccctagatctccccttgcatcccagagggggatttggagagcaatcaagaggagtaactgatgccatgcattcatcaactgaacttaatccttcttctgggaggcccgggagccttcttccatgcggggccagattgagctgatttctgtcacgtaggctgctccgaggttgccttgcccttgcctggcactcatcttttgcatttctctgaatcgctttggcgtgggcttttatgaggttcattaggctcagcacctcccatgtctgcttgggaaacaccacgggcagatggcatttttcttttcttttctttttttttggatacagagtctccctccgttgcctaggctggaatgcagtggcttgatctcagctcactgcaagctccgcctcccaggttcacgccattctcctgcctcagcctcccaagtagctgggactacaggcgcccgccaccacgcccaactaatattttgtatttttagtagagatggggtttcactgttttagccaggatggtctcgatctcctgaccttgtgatccacccgcctcggcctcccaaagtgctgggattacaggcaagagccaccgcacctggcctcttttttttttttttttttttgaggggcagagacaaggaggaagatcagacaatttctcagagttggaattgtgttctgggtattgtttttctcctttatggagataatccagggagaaacatgaagtgtaatggaaagaatttgaggcccaaccttcttgatgatgcatcttcatggagctgggagaccttcgtgccagggtcgactctgctgcttattagctcaggctcggtgccccacggcttggtcctggttttctgaatcgtcagatgcacctggatcagcatgtcttgcataatagggttgctttgaggatccagggaggtggtggctatggcagggcttggacaaattacatgtatgggggagtagccccttcaccccagttttgctcctgaccgttgaagctttttatattgacccgtggctactgtggtattcgaagggctaaatttgttttgtgacttttgccttcagcagccatcgcattacatcatctaccttttcttgtgttcttctgtcgtcgagaatcaattaaaatggtcagcattgctatgaaatggtttatttttttgtggatgttttagagctcctcctctccatctcctgaatttcttttcttgctaagcctattcagctctgttttttagagagttcttttccctcctgctctatgaaaacgtattttccatgttaaaaaaggaagatccatgttgctgtacttaatgcttcatgttttagaatgttagtgccagcagaaagcaccaggagacacccgatgtgcccccaccttggtgagcacctttccccccaggcacagtccctgcttacgggagatttgaggcatttgatcattttttcccgttagcttacagcacaaagtactttgaaataaagattggctcgcagggcaggttgaagcttcaacaccaaaatctctctgttccttgtgggtggatgggagcctgacacctgattacaagctccaggtgaagagcaggtttgagacttacaccttgtttattgcaatctttctttcattttgcaggcggtgggggtgggggaatgaaagcccagaaagggatgtggcactcgggcaggacgggggctgcttctgtgccttttccccactgtgcgtattcttagctgcgcaagtgtcgtgcatgtgcgtttggctcacacccagcgggagtgcccttcttgtgaaggaagctcgttctctaccgaaaagctcacttttcagagaagagctggagaaggcctgttgtccatcttagtcctgaaatatgagttttcattccatggcaagtccttttaatgaaagatggactggagaagctgatgcatagaaaagaaataggttcttttatgtagagggggaaagtgtccactctgcggtatttcctgggtcctgtggcttgtaggcatttgaactgttttgtcttggttctgagagagtcagatgattcagaagctgtgttctgctgaacattcctgccttcttgacagaaatcccctatttttgtggtccccctggcaggtaaaggtggcccctactgacttgtaggatttctgtccatgattgtgtctgaaatgtcattttttctggttgttttccctcttcatgtattagcttggctctttcttctcctctttgtctttaaggtaatttgcaaaggtcacactattcttgcttcttcttagaaatgtcataagggattttcaaagaaagaaaatttctgagtaagagtatctccctcccctcccctcccctccctccactcctctcccctcttttccccttcccacttcctcctttcctttctttctctcgctctctctctttctcatttatgttagcttacatgagtatactgactctaaaaatttttgattctactactgcactccagcatgggtaatagagcaagaccctgtctcaaaaaaataaataaataaaaataaaaaatcttaaaaaaatttagatatgatttgtataccctcagattcactctctgaaagtgtataactcagtgctttttagtatattcacagaattgtggaagcatcactaccatctaatatcagaacattcttaccaccccaaaaagaaaccctaccaattatcagctgctccccattccccacctctccccttgcacccctagcccatggcaaccactacatttctatagcgttgcctgttctggacatttcatataaatggaataatacaatatgtggccttttatagctggcttctttcccttagcataatgttttcaaggtttatccaagttgtaatatgtatcaatacttcatgactttttatggtcgaataatattacatttatgagtagaccacattttgtttgcccattcatcgatggatggcatttgggttgtgtccactgttttggctattgtgcatgaataatgtacatttgtgggcaagcatttgcgtgggcgtgtgttttctgttctcttgggtatataccgaggagtggaattgtggggtcatgtggtcattctatgtttaattttttttttggccatgttactggcaaatatatttaactttctgagcaacagtcagactgtttcccaaagtggttgtgctattttacactcccaccagcagtgtgggagggccccggtttcttcgcatccttgccaacacttgctattgtctgtcgttttgattatagccatgcgagtgggtgttaggtgctgtgtcattgtggctttaattttaggctttattttgaggcccgtgtactcattcactgacccctagtcacatttatcttgacctgtgatgtgagaacttggtttgggtgtgttttccctactctgcactggctcatctggtgtggcaagtgcaaagatgtttgcagagatgagaatgagtacctgcaaccaggggtccccagaaaggcagccctcttagctctccccactgaggacccttgagccctccctctagggctcaccatttgtggctggctggaatggctacctccattcccttgagcctggcaccgctcctcgagatttgctctgatctcaccgcatggctgagagtaaatcctgttttgctcccttttgtgagccttcttctttctgcttcctgatggggtgggcagataggtggttccatgctggggagggaacttggcagaggccctgttagcctcttcctccagtgtcacccttctgacagcacacagcctgcggggtccaggcactctcagccatgatatggaccatctccagggccagtccattcctgccgctgatggagattccctcctgatctccagagggcagaggaatcagaatagtttccttctacatttgtagtttgcaggaaccattgctcacagctgctccctccttggatgctataccctcactctgtaagatagggtgggaaatgtcgcctactttacccatgagagcatcgcagaagggagaggctgagggacttacccaactagtatgaggctgaatgaggactcagatgatggtcatctggctccggggccagcacttaatcctgctgggtatgttcctgggccctctctttttttgtttttgtttttgtttttttttgttttgagacagagtctcgctctgtcccccaggctggagtgcggtggcgccatctcagctcactgcaagctccgcctcctgggttcacgccattctcctgcctcagcctcccaagtagctgggactacaggtgcccgccaacatgcccggctaattttttgtatttttagtagagatggggtttcaccgttttagccaggatggtctccatctcctgaccttgtgatccgcccgtcttggcctcccaaagtgctgggattataggcgtgagccacagcgcctgggccctctcttataggaacttcaggtgctaatgttgcaggatttaggaggacgagagagaccttgggttgaaacaggagaatttttactgagtgtactcaggcccagctgacttacgtttaaaagactgggcctggaacaaagacagtacttgacatttatatatattttataaaagggggtgggctagcttgaaataagctcatagtggtgcgaaagcagggatattgaggcaggacaaagacaggattgtatatgactgttgccaagcaacctagatgtttgttatttaggtttgcctgggcaaaggcttattttataacctttattatggtgcccaggcagctgtagtttaggcttatttaggctttttatgacttttgttgtattttttagataaaacagaatacttgaagttactagttatagagaacaggaatttataaattttataaaacaaaggaaatttttttttttttttttttttatgttgagggagtgctgcgagagtttttaggagcgtattagataatattattaagacttttttgggtctgggccatgcctttgctgcctttgggacaagttagcttaatacaggaaaacttatttttttttaattttatataaaaattctcctgtttcaacccgagatctctctcgtcctcctaaatcccgcaacactaagtgtggttcccttaagtgcactggattcaaggtgactttgtccttgcttttggatgttttggatgtaacagcgatgagatggcccctcccagagctgagaatggagagtattatgctagacacctgaggctgcagtgatgtgggctgatggaggggtgtcaaggagaaagcatgtggtcaccttcatggcaccatcacagcctttggtttgtttaaacaaagtgaattagtgttgtggtttctgctgctaagaaaaccctgttcgtttattcattcacctattcattccttcatccgttcatttattcatttattcatccattcatccattcagctgacatttattggccatctggcaggtgctgatctgggcattagaagtacagataaggtcctctttgcaaaaaacttcttgtctattgggaagacctacaaagaaaagatgaaaatgaaatgtgaagattgctgtactaaggttccagtggaacagagaagagaaatctttaaaatctgcctgggagagccaagagaggcttcagccaataggtcctatgtgagctgacccttgaaagccggctcaaattttaccctggggtggatttcacccatggggtgggcaggagaagggagtgtccacccaagagagagatgtgtgcagaagaatttggtagatgagtctggtgtattttagaatttagactccggatttgaccataggatgtttgagttctatcttcatggcttgctagctgggcaagtgacttttcatttctcggagccacagttttctttcttctttatttatttgtttttatttttattattttttttgagacagggtctcgctctatctcccaggctggagtgcagtggcccgatcttggctcactacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgcgcccggctctttcttctttattttatagtggtagcatacataacacaaattttaccactcgaactattattaagtgggcagttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccctattctattatagttgtttctatggatttgactgttctaggaacctcatgtaaatatatatgcttatgacattgcagaatggccccaagttcacctatgtgatagcctgtgtcagaatttccttttttttatggataatatttcatcgtatatatagaccatattctgtttatccattcatccattgattgatagatacatgggctgcttccaccttttggctattgtaaataatgctgctatgaacatgagtgtgcaaatatctattcaagtccctgccttcaactcttgggtgtgtgcccgtaaatggaattgccgcatcatacggtaattctgcaccacagttttctgatttgtcatataatttcagggttactgtgcagcttaaatttgattgaaggtacaaagtactgagcattgcctggcacataatcagtattaagtcccatcctgaagggccccttctagcctctcctgaaaagtgaaccctttaaagcaaaaggacttttaactatttggatgaaaaaatacctcttcaaatgtagtttatggttcttaaatggaggtcctttttggcacttttgtggagtttgggtgaggagtcagatggccacatttgcatagtgaggtgtgattgggtcctggaatgtcatgccagggagcaggtgaaagccaatgagtattctgccaggtccaaaggcccagtggccagtttccatctggatgggcctggaaggcttcctggaggagggggtagtggccccagctggggaaagaggaggtaaaggaatgggtgagaacctgcctgcctcatcttgagagaggctgaggaagcacagagctgggaaggtagccactggtctccatggccactatgctttgaacatacctttgctgcagggccgatgaaaagttggacgttagctatcttcatctcaacctactccctgtcaagtcttgctttttttttttttgagacaagagtcttgctctgtcacgtaggctggagtgcattggtgctatctcggctcactgcaacctccacctctcctcctccggggttcaagtgattctcctgcctcagcctcccaagtagctgggattgcaggcacatgccaccacacctggctaatttttgcatttttttttagtagagacggggtttcaccatgttggccaggctggtctcctgacctcaagttattcacccacctcggcctcccaaagtgctgggattacaggcttgagccactgtgcctggccacgtcttgcatttaccatgggaaattgttagcgtggtcatcatttggtctgctttagtagagagtatcttttatgtttctcaaaggcgttatgttctgcattgtaaatgtgcggaaatcagtcacccagtcacctgaacttccatttaacatcaggtccctggccatgggacttgggcaggagcaccagggctggcccatcaagtacctcaatatattgctccctgatgagggaggggccagaatacatgttatcactactgtttaacatggttccggatatgttagccagtgtaataagatacgaaaaataagaagtaataataatggggagaaaatataagattattactatttttttttattgcccaggctggagtgcagtggtgtgaactcggctcactgcaacctccagctcccgggttcaagtgattctcttgcctcagcctctcaagtagagtagccaggattacatgcacccactaccacacccagctaatttttatatttttagtagagatgggatttcaccatgttggccaggctggtcttgaaatcctgacctcaagtgcctgcctcagcctccctaagtgattattactatttttagatggtttactttagccattcaaaggaattaaatgaagaaatatttgatctaagaagaaagtttatgaagatgactgacttaaaaataatgtattaaaaattaatagcttccctgtatgtcataaataaccaatcagaaaacataatttaaaaaatccatacacaatagcaacataaaatataaaattactaggaattataagaatacattcttatatatggaatccaagaagagtcttaaataaattaaaagaaatgctatgttagtgaacagaaaaacccaatactgtaaagaagtgtatactttagattaattttaaaattgaaaacctcaaaaggtggttgagtttttgttttgttttccatttgaccaaatgattcttaagtacaggtgaaagattaaacaggtgataagaaccaaaaaatattcaaaaaggtcataatgaataaggctgggagaccactactggctagatattaaaacaaactgtaaaaatataataattaaagctgtgtggtactagctccagaagagacagctatataagcaggttaaagtagaaaatctgcaaatgtgactaactgtatctaggtatttagtatataaaaaaggctacatttcacactcatggtaaaattgtaaaatattcatagtattatattagaagttaactattttgaaaaccaaagtaaacatcttaccttagttcgtataccaaaatatatcccagatggattaaagaattacatttaaacagtaaagtcagaagagaccagaagaaaatacagatgaaaagccatataatttagatatttcagcaaaggcagaaatcagaaaagatggagatgcttgactacatagtaattaaaaacattactaacagtttaataataaaaggataacgaagtaggacattcgacttgcaatatatgataaagggttgatgcatttaaaatatgaaattttaacattttaataaaaaaagcatgctttaatagaaaaggtaaatggtatgagcaaggtattcacaaaaaggaaataattccaccattgaactataaaaaatattcaactgaatgagtaataaaagaaatacaaattgaagtttcactgagctaagtttttatctactaaactttcaaatattaaaaggggttaagtaagctgaaaaaaatgaaactatgttggaggattcacttttatctgttttatttaatttcttttatataaataatacttcaggcaaatatgataaacttaataaatgtcaattctgaggggggaagaataaaggagttaaataagtagaagttgtaatacccagtgttggctaggttgtggttaaatgaacactcaaactgcggataggtatttacattggcatggccctttctggagggtaataagacagacagtatctaacaagagctgtaaaaatgtgtaaacaaaaaaattcatacgccttgacctagagtaatctatatgtaaacatttagctctaaggatgttcattgtagcattatttataatgaggaaaacaggaaatgagctgaatgatgaaaattggtgactggtatagtaaattaaggccatccctagaaaatagtagtatatagtcattaaaatttattttgggggccgggtggtgcctcacgcctgttatcccagcactttgggaggctgaggtgggtgaattgcctgacatcaggagttcgagaccagcctggccaatatggtgaaaccccatctctactaaaaatacaaaaattaaccgggcatggttgcacgcctgtagttccagctacttgggaggctgaggcaggagaatcacttgaacctgagaggtggaggttacagtgagctgagattgcgccactgcactgtagcctgggcaacagagtgagactctgtctcaaaaaaaaaaaaaaaatcattgtggggctgggcgtgatggctcacacctgttatcccagcactttgggaggctgagatggaaggattgcttgagcccagaaattcaagaccagcctgggaagcgtagggagaccctgtctctacaaaaaatttgaaaattacctggacatggttttgtgtgcctgtagtcccagctacttaggaggctgaggtgggaggattgcttgagcctggcaggttgaggctgcagtgagctatgatcctgccacgaacttcacaaagcaagaccctgtgtcaaaaagaaaaaaaaaaatcggctgggtgtggtggctaatgcctgtaatccccacactttgggaggctgaggtgggcggatcacaaggtcaggagatcgagaccatcctggctaacacggtgaaaccctgtccctactaaaaacaaaaaattagccgggcatagtggcacgcacctgtagtcctagctactcaagaggctgaggcaggagaatcgcttgaacctgggaggcggaggttgcagtgagcctagatcacgccactgcactccaacctgggtgacagagcaagactccatctcaaaaaaaaaaaaaaaaaaattgtggaaaatatttattaatatgaccatgttcacagtatattgatggaaataagcagaccatgatttcattatgtctgatttgatacttttttaaaaaacagctttttgaaacataaaaacattatgatgctacttttgtaaaaagtgtatatgtgtataataagtagataggaaaaagattgtctagacatacatcaacatagtaatagtgactttttttggatgattggatgagtcatggaagattttattttttttctccattctttctggtgttccagggttttggcattgaagtacttttgtacttagaggagttttataaaaaacaaaagttccctttgagggatactttgcatctggactgttatctcttacccacatcattcttgaggacgaagagaaaatacctgtgaggaagtatttacatttgttacggtggtgctgggctgagtttgtgtggaccctggactcccagctgtccacacagttataaagagtaattaaaagctccctgaacaacaggtcccttatcagccttaaaccttattgttcagatacattggcttttattcatagtcttactaatcaactggggacaaaaaagacccattgaaccattagccctcagcccgagatgagaagcgcatgatggtacaatggccgtggttcagactcagatgttatgctatgttttgaattcagtccaggttcctaggaggaaaacacccatcaaattatgttggctttagagcgatctcagtcaacagatgacatcaccgacttttccttccctgctggtctttatttggaggggatgcaagaattgtgcaaccttggaataaacagaatagagacccgactcctcactcattgtgtttctgagtttagtttcaatccaacagcggatctgtttttttactccatgtaatgggactgttgctgcagcttttgtacaagggtggagtgggtgtccatttgctgacgagcaccctgtgtacacgctagtttttatttgaacgaggtgctcttgtctttattatgtattgtctgcccataaatgatgtcttgaaatagaggggtgagcatcacctcatttatttcaacccatatttgtacagaaggatttttgtaatcaaatcatggggtttgtgtgtagaactcagtaagaagtaatcatgaccctgtccgttcatttgctctttgttctttcctgttattaacaatggctttggggcttttggggcgcatttagttctgcacgttgtgtatgtaagtagatgttcttctgtgggggctgcaagtccttaagttatagttggattcccttcccagcaaggaaccaacaggaaggaaaacgaagtcaaacccagtctttgcacgtggaagcttgtggcgtgactgttatttttttgtgatgttctgtacagccctgtaatctcttatttttggcaagccaactctgaatctgtggtcccgtagccccaggcaaccaaaagctgagacaaacagaggaagtgtcgttattcacatgtttctctggccacctcatcgggctggacgctgccggctgccacccgtcgctgagctggagctccccagagtgcagcctggccaggcagggactgttgaccctggcccctgtaggaagcacctctggcttgtcccccagcccccagggtccctgccactcattacttctctgcactctttctgtaatttgttcatcgcctggaatttatttctggcagactttgtggtcaaaactgggaagtgtctgtttccttaaaacagcctttcctcaaacccaggaagtgaagtagggagctatccttcctcacctcctccctgtcacatgcacatgggcatacacacacgtacacactcacccatgtgcacacacacaggcacacacatgagaaagggacggggaaagctagggtgtccaccccagcctgggctcctggtatccctaagggttttggaagaagagtttcagtttttcaaagcctgctggagatgtaactgtcgtgatgtttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgtatttgggggctgccctgggatgtgaaaagtctgtttatgtctgttgacagagggtctctatgcttcttccttttctagcatttactcttatgttacaattagtgcctgcttgctgtgtgaacaggacagatttgtcttgtttgtttgggtcgtatgcagtttcatgcagaagacttagctagatgagtgactcaaagttccatgcctggggccctccaccctccttccctcaatcacgcctttatccagtcccttcccacgccctgttcctcattggaatcctctgtcctagcctatcccccctgctctcccctggcatagaagggtgcatctcgtctccccacaacagcactggaaggtgctagaacacttggagaaaactagttctgtaccagggattatgttcagcaggtttatctcctcaaggcacccctaaagtatgtttttactatttaacacacgattttgtaggccctactgttgttagctgttcgtagatactatttcagaacaatgctgtgagtagatactattattaggtccatttcacagataagaaacctgaggccctgacagggtaaggagtcctaaggttctgtagctagccatggtagagctggggtgtaaactcaggctttctgactccaaagttcatatttttaatccctatacagtgaagtaggcactgttgccatttctattttgcagatggggaaactgaggcactgaggagttaagtactttgcccagggtcctagaactagtcagtggtagagccaggattctacccagacaggtgagctctggagccaaagccctgagcatctgtagtagattccttgtggctttctgtcctgtccttgttccgagaaagttcccaggggacagttacggaatcactgggtgcttgctgttctcacacgcacagtttctactggctctctagcatttctttcattagtgagagaatgtttcagcccagcttttcagatggtggagttgaggcccccttgtctgagctgggtatttgagagccagcaggcttgagggcctgtgaggtctctggaggacacggtggtggtggggccaggagaagtcacttcttgggactttggaaagcctagaggaattccagaaatgaaacaccacacacttactggaagccaagttcgtgtttctcccactggtggaagggatatgaggtgctgtaaacgtggccttttttcagatgcagaatgcctgtctaattacaggaaacagagatgtcgccccacactgagccaaggatttcaacatctcttggagaaattctgcatggacctgaagtttgaagctttgcattgtaaccaagttggctctccttgccttccccccaggccacgatttcgtcatcctgctttacggatggcatttcctattaagtgtctgtctgtgaacataaacatggagctgagacaaagcacagcttctccctggacccggaaagagggactcaggcgcctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatcatgtggttgtaaaattgtcagtaacttctttgtatggctagttgatctgatctctcatgtaggactcagtcccccagttggatcttggaaggtagacatttatttgaaacagacagcctggtagagtgaaaagagctttgtgttttaccccctcagatagtaagcaaagaaaatggaaaaagcagcgctgtctggggtgacatcctgatgcattgctggtgacagagtgaagaggtgacacatttggaacataatgtggccatctgtatgaagaaccatagttcatccagtcatcccaaccctaggactctccagagaaaaccgtttaaaatagggggaaagttatttgcatgaatatgttcataagaacattatgtataatagaggaaatttggaagaaacctataggttcttccacagggaaattgttaaggaaatgatggtagattctccgcaagaatggctcccattaaaaattgaattagtaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattggctttttctcatgcacattaggttaaggtcagtagttactcacttaagttacccattgcatgtgtttccagtgacagaaaaggatttagggatggatcgttgaggtgactgctatgcatagaaatgcctagaaggaggcggtggtttaagctgtagaaggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaaaacactatgtctatgtgaggttgatattattgctattcaataaatgcaaacgtgtaggaaattataaaatgattcaactgttccattcctgtttttgaaactttctgaagagaggtggatatgtttccctgaggtggggagctagggttgtgcctgtgttcatccaggaaaatgggatgaaaagcccaagatacatctgcgacatcatcttcagaatgtgaaattacagtgggtttggaatctgggccttctctctgcctgctccctgcctctccttccctacccacagtctccagctctgactcctggcctcccagggtcctctcccagcagcctggaaggaagggacatcctcattccagggcccaggccatgaggaaggaagcagtgggcagggatgcaggctgcaggtgtgggcagctccaggtgcccactctaggcttcaggatgagtggctcccttcctgcagtgggtgcccatcctggcaggtacagtcaccagagaggcccgcctgcttcagctgcataccatggggtttttcctgagactaaagagggtcctgctccttatatccattgaccagtgagtgatgaggaagactgaatgctgacggacgggaggaaggaagtcaggagaaagggagaagggctggccaggaaggaggagagaggaaatgacagaggagagggagagatcaggagccccatgcctgccagccagggaaggccctgctgttgcactcttcagaaccccaacttgggacattttgaatagatgttaggagtgtgagtggaatctaatgagtgggacagacctcccaagtgagcattgaatatgagggcgggtggggcatggtagctcatgcctataaccccagcactttgggaggccaaggtaggaggatcatttgagcccaggagtttgagacctgcctgggcaacatgggagacactttctctacaaaaaattaaaaattaactgggcatggtggcacgtgcctgtggtcccagctactcgggaggttgaggtgggaggatcgcttgagtcctggaaatcaaggctgcggtcagccagattgcaccacagcattccggcttgggtgacagaaccagaccctgtctcaaaaaaataaataaaagataaaaaataaagaaaatgagggtggaggaagaagagccagcggaagattcttctgagacatgggaagtaaatttgcaagattgctgtctgggagctggacagacaggaagggaacagaactgggatgtggcagggacaggttccaggcactggcaggatgggggccagtgtgcagtgggccaagagggaatgggagcgagaaggtggggcgtcagcaacattcagctccctccatagctcgatgagaagagaggggtggggacaggcggtagctggagggtccttcaggatcattttatccgtatccctttcgtatcttttagtgagtttttgttttccctaactggattgttggcattttaagggcacagtttgtatcttctacctctttgtttcctccaaagttggccgatcaccagatcacttaaaggaggttgtttgttttataagcgttttaccagatcttggcttaacacttcccccagagttagtcataatcattctagcagggcttctagatgctgaacaatgaccgatggtgccacttgatttatatgaagatactggtttagttttaaaagcaaacttacattgaacaaagtgtaggaaagagaaaggagagggctactcaagtgcctgaaggtccgagcagtgaagaacatgtttccatatgcctgccacccttaggctaaggacacggttttcctatctgtttattgaattgggtcacttgctttagttataatatatgaagggataagactgaatttcacttctcaattaactagccctcttgctctcttttgatcacacgttctggggtcagattccagctctgccagtcagtggctgcactggccaaggccacgtggttgaccaccatccagagttctgccaagagccttacctgccagaggcacgggaggtgtggctgttgcgcagcttctgtggcccaggccctctgcctggcacattttaagtaatgtgagcggattacttaatcttactgtctgttcagctgaaaactagggccaaccctggctcagagctcagggggccgttgcgaggattaaatgagagaatccatggaagatgtttagagtcgtaccagacacataggaagtgctgaataaatcagaatggtttttactatgactctcacctttcaatgtttgtgacttaaacttatgttacagttagtcatttcactggcgtgtgctaaccaaaggtggcctggcccctccgcatccattaggagggcttgagtttaaaatccaggccctgtgagtctgcagggaggaccgacgggagagctgggtactcctgggacttcagtgtccagtggatgctggggttctcaggttggtatattgagtcacatagttccatgactcccttggaggaagaggctaaagttgtctagaggcaggtgtgatgtttggtctgtcctgtgtgcactgagcaccttctgtataccagtccccctgcttgcttcttccagacagaagaaaacacagatggcaattggtcatatttgaacagtgcctcttatagcttacaaataccatcttattgaacactcatgaaaaatgctgggatgtatgttatttttactgtttcaaagatgaaaaaactcaggcacagacattctaaatagttccagctcttaggaaaatgcttctttagcattgcgggagaaacagtatatttgtacaaggcaagtagttcaccctgtaaggcagcacgtgctttggaggcacctaaatactacacagtgttttatgcatgggcgtttttcttacaaaggaacatagctttatcttcctgggggtgtttatcaaaccacatctatgtagcagatgctcttcaagcatttcccatattccctcgtttacaacaccctggaaccctgagttaattattagtcccatttcatggctgaggaatctgaagctctgagagtttgaacttcttgtctaaagtcacatggtgaggaagtggtagaactgacctggaccccaggtatctggctctggtctttccaatagtgcctcttcagtgggtatcccttaaattctcaggggcaggtgctttctcctccttttatgccctttttttcagagcaaaaccacgttatcctaactgccaagcacaacccacaaaggctcttatctctccttcaaaaaaagccattccctgcctggttgatgaggtcacctggcattttgcagggcattttgcagggtagatgccagctcgggaaagccacatagataagccagtggatggcttgtgttactgcctccctgatggtttgcttttaattcaagtcgattcatttatctgagatgaaaaagggagaggctgattcacacacattgaaaagcagggaatggtgctggagaatgaggccgtgactatttggaataagatcctggagatgggcagtgctgatagagtaaatatccagggagcaggggaaggtgtgtgcactgacaacaggagttttagcatctgcccctccttgcttcaaggggctggcgggtacccgaggcggggtcggagggctgagtgatggctcccatcctccctcttccctcctgctccacgggtgtaaccttgaggtgggattggagggcttggtgacctctctcctccctcatgctccatgggtataaccccaaggtgggatcacaggctgagtgaaggctcctcatcctccctcctcccttctattccacgtgtgtaatcccaagatgggatcagagggcagggtggagggttacacatcctctcccctccctcctgctccacgtgcgtaacccccagctgacttacagactgtggtacctgctcaactgcttcaattccagaactggaactgcagggaagctgtttctgacatccctggttttaattacaaagggccccttgagaccttgtcagaaatactgccagcctagccctttaaaaactcatgatattgggttctctatcagtgtcgctccctggctgtaatattgtactataattaggcaagatgtttcctttgggggaaacggggtgaagggtatgaaggttctctctgtgtcatttcttaaaactccatgtgagtctatagtgagttttaaaaagaaaaagttccagcctgggcagcatagcgagacctattgtctctacacataataataataataaaattagacagtgtggtggcgcacgcctgtggtcctagctatttgggaggatgaggtgggaggattgcttgagcccaggagatcaggactgcagtgagctgtgattgcactactgcactccagcctgggtgccagagcgagacgccttctcaacaaaagaaaaaggataaaagaaaaaaaaattaaaagtagggtcatttaaatatggcaaactccaaacgggtcttctctttgaagttttagggagcagcttatttactttgtgtctcacactttgctaatatccaaaatgcagaacattagggaaccgcttgaggcaggaggggaaggaagcactgattctcgctgcagcatggatgaaccttgacgacatgatgccaagtgaaagcagacagacgcacaagactacatcttttatgattccattgataggaaatgtcctgaataaacaaatctatggagacgggaagtagattgatggtggccagggtttgggagtagcaggggtaggagggaatggggagtgactgtaagtgggtaccaggtttcttttttgagtcatgttctaaaattagattattgcaatggttgtaaagctctgtgagtgaactaaaagccaccgggttataccctttaaatgagtgattgcatagcatgtgaattatacctcaataaaactgttaaaaaaaacagtagggtcctttgatagttttaatagaagtcataataagaggaatagtcctttttcagagactgcttgtaacttgcaaattcaggccactgtcctggggcatgttcctggctctcataaaccagattcacaggcccaccacgcagaccatgagggtgtttccagtcactcatcttgagggaaggaacacccagtgtgtgccaggcattttgccaggtgcttttacctacgctttattatgtaaactttttgcagccctgcatggtatgtggttttacgccttttttttttttcttaatagacagtctttatctgttgcccaagctgaagtgcagtggtgcagtcatagctcactgcatccccaaactcctgggctcaagtgatcttccccacttagcctcccgagtagctgcgactacaggcacataacaccatgcccgggtaatgttttttttttttttttttgtagagttggggtctcactatgttacccaggctggtcttgaactcctggcctgaagcaatctgcccacctcagcctcccaaagtgctgagattacaggtgtgagtcactgaacccagctcatgcctatctttttatagatgagtaaatggaggttcctggctgggtgcggtggctcatgcctgtaatcccagcactttgggaggccgaggttgggaggaacatctgaggtcaggaattcgagatcagcctggccaacatggtgaaaccccatctctaccaaaaaaaaaaaaaaaaaaaaaatacaaaaattagccgggcatgatggcgcgcgcctgtgatcccagctactcaggacgctgaggcaggagaattgctcgaacccaggaggcggaggttgcagtgagctgagatcgcgccactgcactccagcctgggcaacaagagtgaaacgccatctcaaaagaaaaaaaagaaaagaaaaaagaaatggaggttccaaaaggctaaaccacagtaagggagtactgcagcaaaaactagaatttgggggctccttgacccccaagcctattctcttttcactgctggtatagtcgggttgccaaggctgccctcttggaggggccgatagctcagggaggtcaccagaggaaaggcctgtgagctctgtgcaagtcattttcaggcttgtgtcctcagtggggactctactccctccggaagtgagtatgacattctgccctattcccttggagcagctcttcccaggagagcttcagtggaaagaaaactgtgggaaaacatttggaggcatttcatggacacgtttctgagtgttatgagctcttgaaggaagcatgtttatttccccaaagtgctcagctgtgtccgggtcctgagtttttcaagggtttataacccccggagctgaatttggatatgcaaggaagccatgggattgcagccagggaacatgctattttttgtaagtgatgatgctgttgtgtagtaaacaggcccctcgtggtaaatggagagcagtgaatggaggtggagggagaagttttgggaaaagatttgcactcagttaatgatgctcaaggtagttcaaggcagactcagtagctcccgggttgcttagtagaaatgcagattactgggtcccagtctggacctgcagcgtcagaaactctggggtaaggtctgggaacctgtgttttatttttatgttatttttttgagacagggtcttgctgtgttgcccaggctggtcttgaactcctgggctctagtgttcctcttgcttcagccttccaaagtgctgggattataggcatgcgccactgcacctggccagaacctgtgttttaaggaacactggagatcattactgtgcaccctgaagtctgaggagtctagcaccagatgatctgacgacacatcattgggatgtggagtcatggttccagtcaccagcctgaagttgtccttgtctgtcaccctccccactttgtctaagggtgagtggaacagacagaaagtagactagtggttgccaggggctgggagtagcaggctaggagggaatggggagtgactgcaggtgggtacagcctttcttttttggtgatgttctaaatctagattgtggtgatggttgtaaggctttagatggcttgcttgagccttgcaatgggaatgagtgccttggcctaaggagaagggaagaaaatcttgtggaggaaatgagcttttatttttttcctttttttttgaggcagtctcttgctctgtcacccaagctggagtgcagtggtgcaatctcagctcactgcaacctccgcctcctgggttcaagtgattctcctgcctcagcctcctgagtagctgggattacaggcacctgccaccacacccagttaattttgtatttttagtagagacgaggtttcatcatgttgcccaggctggtctcgaactcctggcctcaagtgatcttttgccaccagatattaaaatgtatcaaaaagctgctctatttagtactgattgagatgaatggagcaaaatagcccaggaacagaacctggtattgtctctctgtaaagtatgagtgaatttaaaacattattagatatgttatctagtaataataatgataaagtattttttaaagtcatcatgaatcaatagaaggaaaggattattcagtaactatgagcatgtgggtcttagtgtcaccagtacttatccttcttcttaggagggatttgtttttttaatcttaaaggaaatagatatgttaaacctatcaggcttccttatttacattggctagagagcctaactctaaatttagccaatgtataagactaaatgtcaagtatttatctatacaaacacacacatatgtacacacttgcatccacatctacatacacatattttacatacacatatacacatataaatacacacgtacatacatacacatacatacatgcctctttcctgattttattttaccattatttttcttccgctttatcttgcattactctttctggtttatcacattttcttgtattttatgtatctctataaaccactttaaaactttttgggggaagaaagtggactatagataaagaaatagaataaggtataatatatagaaaaaaggcagtaaaaatacacccaaatttgaataggttgattttggggtggtggtggtaatgggattattaactttccctaaaattttctgtatttttgaaattttctactcaaagaatcatatcatcagaaaaaaattattatttctgctcattccctttgctggccagtgaaaggaatgcatttccataagtgagggtctggcagagcagtgttgaggggaggggtctttgccgcagcaaaagctggtccggttcccaggagagcccctcctttgctgcttgacctgattgcaagtggaatgtgagagccagaaggaaatattccatcacttatttagagcattcatttggctcttccctgatctaggcgttcagtacctgctcagagggagtttacattctagtcaggggtcagagagtaaatgagtgaaatggattcagaaacgatgccaccctgggatggtgacatatagccccagtgagaaggatgaggagatgcccaagtcaagagcgaggggaatgggtttccagagagagagagggctgcttgtgcacaggcttggagttgcccaggggttgggcaggtcaaagtgaagaatggccggggtggccattgtgggtgagcaggtcagggataaagagtaccttggagagatcaactaggaccggatctgactggccaagagaaagagtttgaattggactctaaggatggtagacagctactaaaggatttaataaggggaatggcagtgtttgatgaaaggtttaagatccttctagctgcttctgaagggtgatttgtagaaggacaagagatgaagccaggggagtgggtagggagattctgcccaaactgattgctacacagtgatatttttatgcttttcttttttttctttctttctttctttccttccttccttccttccttccttccttccttccttccttccttccttccttccttccttccttccctctctctctctttctttctttctttcttttatttttgttttgggtgttgatgaggggacatacaacttaagaagaaaaattggaattattttgtcaacttttctacatcagcattttactgatggaataagcttgcatttgaactggacatcatttttgtttttattagataacattatctgtattacagataccagatatgtgtgtacccatttatttactaatcactaatacttacaaaaaagtaaattttgtcaaaagaaaattcagcttagatggccatattgtatgtgtgtgtgtgtgtgtgtgtgtgtatatgtgtgtgtgtgtgtgtgtgtatatatatatttttttttttcttgagacaaggccttgctctgttgccctggctggagtgcagcggcacaatcttggctcactgcaacttctgcctcccgggctcaagcaattctcctgcctcagcctcccaagtagctgggactacaggcatgtgtcaccatggccagctaatttttgtatttttagtagatacagggtttcaccatgttggccaggctggtctcaaactcttgattcatgtgatctgtctgccttggcctcccaaagtgcaacggctatatttctgacatatacaaatccaagcccagttgatcagaatttagcagtatctgcaagatttgaaccatttcagaaatctgagctctctagcattacatggactgatgttttcttagctcagaactgcttacctgtgtgtagaaaatctaatatttaggaagaataattcattgctttaagtgttcagtcctggtttttatttctattgttgcacaagtttgatttgaccttggacaaatcatttcagtttgtattttagtgcttgtgtgcagaagatgggtagtaatagtcctggtaatcctcctgccatcatgttaactgggtgagagctcttcaagacctaggagagataatagcaggtgcaaagtccctgtggtgggaggcagcaggtagatattttaggagctgaaaaacggtctgtgtagctggagagcagggtacaagggagaggtggtccagggtcatgttatagaggtaggccagggccacactggttggggttttgcaaaccttactggggacttgaatctttatctgaagagcagggggaagtcattggaggatttaaatcagggaatgacataagattgatggatatgctatctcctttaatcctcataacaaatgtatgtgctaggtaatatccccgttttaaagcagcacagaaattagggcagtggagattaaggagtttaccccaggacaccatgcaggtgaatgatggagccaggaaaccaactcgggtcagcttgcatccaaagtcctcagtcttccagatcagcgtacctccatagtaatataacaatgactgcagttttaaaacactttgaactcttaagatgaaagatttcccttaaattacaaagtggtattatgctgcagaaatgtgagcggtaatgagagagcaggtaatgcccgggaacttttgaaaggcccggtccgtgtggctctgctccagcaccttcaagttccctgccgtctggcggggggcgtctcataagctgctttcaacacaaagaagggtttggctgctccccggccatttgacactgccattgtccataaggactcgttgtccgtgaaatgcacccaaagcttgagctttcaggggttttgggaaatcagatctgggcagtgcatgtgtggtttcgctggagacatcatccaatgccaagtttctgctttctgctttctccctcttggataatcagctgggttacatggattcttagaagctggttgtagagatcaccatctcgattttgaacccaagaagccttattcagggttcaagtgggaaaatacctgctggcccacggcccttgaggctcttggtgatgatgacatatgtctgtttctttctagttgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggtaggttgcactgagtcaatgccctctgcagatgtttccgcttcagtccatcaactggcacagccctgggaagaaagtgataatgcttccagatcccatttgtgcctcatgcccatgcctgcccctgggaaggagagagggctttgggccgcagcttatgctgtttggaggtggccttacccagtgcagtaacatgagccttcattgatgataagagaagatgaggcttactgctgggacctgttcttaggtgacagctgctcacagcttattggtttgtgagcaccgtgctctctagccagggtggggagttgaggctgctgagagagagatttaccctcaaaagataacaaatacatatctcagtgaggatttgacagtctcaggagagtgttgggcagccccttcctacaaacctggatggatctaggatagatttgagggctatgagacacttcaaaactgagtgacaacctgagagggcttttcctttccctagaattattttggagaacaaatttccagggattgggaagattcacagagaggcaggaggaatctttaccacctcaaggtgcctctgggactcttgtcaacaagaacctcgggggtttgcggggaagagccaggccacatcatcttcctgggtctcgctgggcttggctagagaccagattaacttcactggatcttagtgttcagggaaacacctattgctttagggttctggggacttccaggcttagaaacaccatgtgctgtgagtgacatggcaagagggaaatctctaggtactagaatgatagaaaatgccccggaatgaaaagcaagagtcttgggtttatttctctgatcttccacagactaactgtgtgaccctgggtaatttgctgaaattttatgggtctcagttttttaaacatttctcatatatgagggtcttggactagatgtcctctaagattctttccagcacaaagcttccacataaaagaaaataggtaaactttgacttttctcacttttgatcatgcggagactccaagtggtttaactgtggatacttagactgaatctgctccaaaccaggcaggagggttaccatggtaactgttgcctggcaacgggagaagggccaggatgtccagaggcatttaactcaggcagctcccagcaccccccaggtggcttgaattaaactccaaggctgcgaggttgtcaggacaattgtttaaaattgtgatgaatgttgggcagggatgtttggtctggtgcctagggaggcaagaactccaagacgccaggatgagaattgcgacatctgcttgttgaactaatggaccttttcttacttaaaaaatcatttgcttaaaaatcagcatggaaggcagtctgtctgccaaagaaaagacatttatcacagttcttcataggcagaaacttctaattcattttcttgttacagtcgcaacagacttgtttggtagaggcagcttaaaaaattaactgtggtaaaataaatataacattcaagttaccatcttaaccatttttaagtgtgtgtgcagttcattgttttaaaatacactcataatgttgttgcaaccatcaccaccctccatccacaggtctctttatcttgcaaaactaaaacgctacactcactcattaaacactaactctccactgtccttcaccccagtccctggcaactgctgttgtactttctgtctgtgaaattgacttctagggacctcatacaagtggaatcatatagtatttgtccttttgcaactggcttatttcatttaccatgatgtccttaaggtttctccatgttgtagcatgtgtcagggtgtctttcctttttaaaggctgaataatattccattgtatggatagaccacatttggtttattcatttatcagttaatggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacattcacaggttatttatatggtactctgcttcctttaccattctgtgtctccatttctctcctctctctttctctgtactgaaacacacacacacacacacacacacacacacacacacacacgtacacacacagacagtattatcactttcttatcccttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggcaccctgacatttggtaccttcaggctgtggccgtttgggaaagcagtctccgatgtatgcatgtttcctagcttcctgggaagtggctggtggatgcagttactgatgtaactgagccttggaagagagtatgaacgcagtgccctggcccccagcactgccactccgccgccctggatctgaggctctgccccgcacggcgtgtgtgggagcggcactcagaacctccttagcaaacctggtgcagagccaggtgtcacccaagagcttctcactcccggtccacgtcctgctaagttgtactgcctctgttaatttctgaggggtctttctccatcaaatgtggccagtaacattgccctcatcatatcaaaaaaagtcaggctaatagaatcgcctaggtgtcctgtttctcatcccagaaatgcctctggtggggagatgattgtctttgtgaacaggaagatggaagtccctgtctctgatcccacccttgtctctctctcagatttatgaagtactgagtgtgatccgggatattggcgccatagcccaagtccacgcagaaaatggcgacatcattgcagaggtacagggctttctttttcgtcatttcttcatcacctggagggtgagaggcaggctcaagaaagggaagctgcatctgtagcttaacaccaaggtggaaaagcagagggacctggtgttcccttgctggagctctgctcagtctcacccatggcatgaatgccagtgacacacgtgcctctccgtgtgtgccacagaacatctaagtcagttactattgcagagagaggccatttctctcggtgctgtaacgcagctgccttgggtggggtacgggaaccctcacgtcacacacaggcattttacaccgtggctgagggttgcaaatgcaccagtcgtcagcatcccagggaacagctgaatgggttttgggaggctgtaattgatccatcctgctcaggcgggactgggaacagggcagtgaacccttctcttcatgaggtcttgggatgagggcagaacgatcggcagtggtaattttccatcttgcccggataactgcatgcccgggcctctgccatcagagctgtgcaaaatccactctccctcacagcctgactttctctaaacattgcaggagcagcagaggatcctggatctgggcatcacgggccccgagggacatgtgctgagccgacctgaggaggtgaatgttcaccaagcggaatgcgtgaatcagtgtcccttgggcactgtgcagagcctcagggaacctgcttcctgcctgttgagaagggggcttctctgatgctgactgtggtctttctgagaagctgtgggtcacgtgtgtgtctgtctgtctacgcaggcaaagtgaagtgttagattgctcctgagggtaaggtggtgtggactgtttcgccagaagattcttctttctgtctgtaattcttcaagcccttgcttgtatagacacaaacagttcttcattggcatcctgcaatgtagattttagtggttcacaacttatggtctccaatatcttaccaaaattcaccaaaacgtagttggaaggatggaaaagctcttctaaatgcctagaaggcgtgtggggaattgtttttccaaggtaaccctgcacaggatatcacatgatatgcagagtttggtagacagaatcttttaaaattatggagggaagattcagagcaggggcctgtgctggctcaaaggtggagactcaccgtcttggtgaggtgtgtgagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagcctgggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgaggggaagggatgaggctggaagaggagaaaggagtcaagacaggcagaaagacgagagtgggagccactcggaatgctttgcacacagtcagggtccacgctttgttctatccttcttgctgcatgcatatgcacacatagacacacatgtacacacagacataggcacacgcagacaggtaggcacacaacagacatagacacacatgcatacacatagtaacacacacagacacatagacacacagacagctagacacagccatagacacctacacacacacacatacacatagacacacagacacatacagacacagacacagacatacacagacacatacacatgcagaggcagatacacagaactgcatgctccaagacactttcagtagcatttgaggccctgaggacattttcctctccccagatgacagaatggaagccgtgacattttcaggattgcacgttcctgcttcaggccagggatgcaggcccttttgtagctatcaaccttctcatgcgtgctaaaggctgaaagggtggcctggcacaggcccgaggatgagggaggcaggcaagcccctgtgtcagctgagggaagccccatgctgagaccgtggctggtggacagtgattgcaggggacagcttgcaggcgagagcaggctaagatcagccgaccataaacatgcctgaggctgattttattttattttattttattttttttcctttttctggagaacggggtctcactatattgcccaggcaggtctcgaactcctgggctcaagctatcctcccacctcttagcctccctgagagctgggattacaggcgtgagccaccgcgcccggccgaggctgattttatgcacatttgtgtgcacacagatccacgtgcacaagcacacacacgtgcacacactcacgttcacacacatatacatacacacacgtccataggcacagacatgcacgtgtacacacacagacacattttagcatacgcacatgtgcacaggcacagacacgcacatatgtgttgtacccacgtattttcacatacacatatacacatgtacaagcacagacacgcataggtgtacacacacattttcacacacacatgcacatatgcgcttgcacacacctatgcaggcaccatccccctttgcagacaccgcaagggttcgtttctgtggtttcacttctccctctgggccggcttctgtgactgccctcgccagattccccaggatccacctgtcgggtggtttaaaccatggcagcataagccatggttgctctcagccctgacctccctggaattgggctttgttcccagggctttgttcccagggctttgttccgccctgaaacagtcttgggattgggccttggaaatgcacagagtccgggagaggtggagggctgacacagttctcacgtgagccctgttcaaagctgccttcatttagtgctcacgtgtgctggacactgtgttcctggcccacatttcagttttgtaactgtcctgtgcaggaggtacaacatctccttcccacaactccagggatgccattcatgcaggctgcatggctgtattcagggagcaccatttacattctactgcccatgagtggtggtaccagagctgtgctgcagtgggctccttggttatctctctttagatgaggacactccagaagcatgaagttaagtgactgcccagttatcaaagcagagagctagaaagtgcagggtcctgcctgctaccccaacccctcccgcagtgtacacatactcagcttaaagccacacctggacctgggctttattagaaagtttcctcctgctttcctcccgtttggtgactgggagccagtccctctgcctgccatgtaccagctgtacaaggaggtgagaagatgtcctctgagaaaagcaaatgccacttctgcaaatgctacatgaggctcctgctgagaccctcactcttcaagttttagagccttctgaggggcttgcattccttctttctcctgctttctgcagagaagtacacaaacacagaaagaaagggccctggctttgctgaagaggaaaatgctctcagagagttgttattctggttgcttgtattcatccattttcatactactgtaaagaaatacgtgagactgggtaatttataaagaaaagagatttaattgacttacagttctgcatggctggggaggcctcaggaaacttataatcatggtggaaggtgaaggggaagcaggttccgtcttatgtggcggcaagagagcgagtgagcagaaggcaaactgccacttttaaaccatcagatctcgtgagaactcactcattatcacaagatctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagctgttgccctgagaacttcagaatccccagcaactgattatggagtctccttgagggctggcagatccagggatgcaccagtatgggatgcagtttttcagctgatttagaggcccctcttgtatgccaggccctgagtccttttagccatatgacagcccagtgaggcgaggaggggggatgcagggggtttgaaaggcttggatagtggcagagcgtgattagaactcaagcccacaggcacctgccggctgacgtctcctctcatggtgagtttgtcaagagggatctgttgtgtgttaaaccctgtgtgggtgataaagagaacaagtatggaacaattttgtgtgaattttagcttcccagtctacttggggaggtgctgctgatggaatgaaacacatcccagtgtaacttctctgtagtttggtgacctatccatcactagcatgatggttctcttggatttgaactttccaaaacatgttcctaacccactaggcctttcttcccaacccaccatgtgagaccacccagtaggattttccctcgttttccacccagaggattggaaaggacactagggagtgcagacatctggaactgaaccatctgtggctgagaggagtggcgactgagcctgcgtgacaatccgggcagtgcctggcattgtggggatgcaaaacagataagaaagtgatcctttctgaagggactgtggacaaggcgaggagaaagaggtagacagaaagtgagtgtagagatagaatttgacagtggctctgagctgtaagactgatgtctgggaagagagtggggacttggagatgaggataatgaagaacccttcacagggacgggcactttccagcaggccttgtagaatgacagatgtcctgacactgctctgtgtccctggacaggtcatttccctttctgagttacctcatcattaaaatcagaagataggcgtagtggcttgtacctgtcatcccagcactttgggaggccgaggtgggaagattgcttgagcccaggagttcaagaccaacctgggcaacatggcgaaaccccgtgttgggacaataaatggagtagtcacctgtatctctgggaggtgctgagggttctagtggagtccatctcacacttcacacccatgcaagacgtccctgtccccgcctggtgctgccgggccacaggcatctctgctgtaagtggagagagagggcttctccttcagctgtcttaggaatgaaaaacatttgggtgtttaatatgctttttcaagagccctttgcttggattgtggatttctagacatcccttttcacatagttgatgcctgaaaggccaaatgtgaatgaagttgtctcagctctgctaaattagattaccagttaatgcaattacagaatttaatcttttggccaagctctggtggagacaaggtaaccaattcagttataggggctcagttatttcttgtgaaaaataacagtgttctgtggagcagcctagactgaaataccatgaacataaaatgaaatcatttatatgcttagcaaacatttttgagcacctgctgtgtatcagacaggacattgggagctattgggggcagggcatggaagatactaagcagtgagtaagccccagtccctcccctccaagagttcaagccagagcccttttgctgggatggagagggagccagtgatgttctgagatctgccttccacaatttcacctgctccttcccttgctgattggtgattcctctgtaggatagaacttgatccagggagtcttgcctgatcagatattccacagtcatcatgtgggatttgaaatatcattcatctgaacatccgatgtatttatttatttatgagatgaagtctctcgctgtcacccagtctggagtgcagtggcgccatctcagctcactgcaacctccgcctcctgggttccagcgattctcctgcctcagcctcctgagtagttggaattacaggcatgcgccaccatgcctggctaattttttttttttttaatttttaatagagacagagtttcaccatgttggtcaggctggtctcgaactcctgacctcaggtgatccacactcctcagcctcccaaagtgctgggattacaggtgtgagccaccacactgactggaacatccgatttaaagcgccagattatttactcaagcagttcttcaatcttgtgctgaaggtcgtaccaggctgtggctggccatgtctgtgcttcacacacagggggccattggtgtagacaaacggggcccactccgttcctagagccctgtgaggctgcattgtttcgtgggtgatgctgacttcattcatgagcatttaatgggagcccagcacaaactccacatcactgaatatcttgactcaagaccctgggagcagaatgaatatatggaattgagagcaatcagtgtctgtgtgtggcggttctcaaacgttagtaagtgtgaaaatcacccacattgctgggtcccgccctcagagtttctagcctgtgagtttctagtccagggcagagccagaaaatctgcatttcttacagactctgggccagtgctgatgtcacaggcttgctgcctgcacctggagaagggtcagaagggagttttcttttctttttcttttgagacttagtctcactttgttgcccaggttggagtatggtggtgcaatctcagcttactgccacctctgcctgctgggttcaagtgattctcctgccttatactcccaagtagctgggattacagtcacctgctgccatgcccagctttttttttttttttttttttaattgtatttgtagtagatacggagtttcaccatgttggccaggctggtcttgaactcctgatctcaggtaatccacctgcctcagcctcccaaagtgctgggattacaggcatgagccactgtgtccagccacaggagggaattagttcaaccaaaccaatgttgagagacacaaggcaagtcatactcctttgaattgtcccctggggtaggaccttggagaccagcagcctcgccttcatcttagcctctctctggggtggaggataaaggtagcggctcgtggggtgggctgagccacattctcatgctctgctgctgttttgcaggtcgaggccgaagccgtgaatcgtgccatcaccatcgccaaccagaccaactgcccgctgtatatcaccaaggtgatgagcaaaagctctgctgaggtcatcgcccaggcacggaagaagggtgagtgctgtggccggactggctgatggcaggtggggaggtttggaggggaggggggctcctcactagggagggctccttttccagaccctcatgccaagtgggccacttgcaccatgttctggcattaacctaattacagccgggcaaggcaggagctccagtttcctcctctgctccactgctgcggccttgttagtatctatttaaagccatgtgcacgccaaggcggggtgggcaggcacatgtcccccagcccccgtgcaagagctggacttactttgatgtggttgaaataaactaggcacatacacagattacgtcagtttccatccgccccagaatccttggtcacatcatgcacctcccctccaaggctgggagtgatttctgccggggtatgtaaggcagctttgtggggtgtggggatgcattttgccccagacactatcacatccagatgttttggtgcttgataaactctcttgatgcattctgaactggggctgggtctctggtattactagggtgtccactgtaactaactgatgaagtgcagcttccagtgcttcctctagaggacgccccatgaggcacctcatgcattttgaatgcagctgagccctgttgtcacccaccgctgacaacatgaatttcgataatcacactgcatcttttatgcttgggagttctctcctcgtacagaaagcctgagggcatgtcgttcattttgatggtggatcttaggctgatctgaaatgaacattataaaagggtccccttctttcttccttcctttctcccttttatgttccctcctcccctttgcctgttgggatctctccatctctgtgtctccacttctcttcccttctttcctgatttctgtttcattttatctttcatttgactctttctcagtccctctgtcattctctctctgtgtctttctttccctgttaggaagggagccatttgacctctatggcttggtttctacttccctgcatcatgcaatccacatggatcaaggtgggctgtgggatttttttcactggcgggtgacttgctgcaagccctggaacaaattgctcaatgatgactgagtcatcttgtcccagagatgatgacttccagacggacccagcgactcctggccctggttctttggagtgctcctggggcctctgtccttaggctacacatcaaatggttgctgcctttctgtcttctcctggcaccttgaaggaattgccttttagaaataagaaagcattcacctaaaataatgtaacctactcagaatgagctttgagttgttttctaggagatattgtggatgacgatggaatcggtggccttgggccacccagacacgcatttgcaagaaggcagcgcatttgtgggaatcagcctctgtacagaaggccggccacagcactgctgcccccacgtagtgtggggatggttggcatagtgtctgaaagggggaaagaatgagacggcttattttctgtattttactactgcgctgtacctagatgatgatgatacgtgagttaggctaacatttcaacgtaattttggatagagaccttgtctaaagtttacttcatattcaaacctgtccaaatgagaagacggaggggtcctacatgtcccagactttagttgggggaggtggagtcgtgggccagccctgccgcaggcctcctcctctctgtccctcagggttcttctcaggtggagttgcggagctggagtgtgttgttgcggtgcccagtttggacctattaccccaactcagtgcctggtagcccccgttgttgttttttttaatttattttattttatttttgagatggagtctcactctgtcgcccaggcaggcgtgcagtggtgccatctcagctcactgcagtctccgcctcctggactcaagcgattctcccgcctcagcctccttagttgctgggattacaggcgcccccccatcacacccatctaatttttatatttttagtagagacggggtttcaccatgttgaccaggctggtctggaactcctgacctcaggtgatctgcccgcctcggtctcccaaaatactgggattacaggcatgagccactgcacctggccacccctattgtctttataaccttgacacactgtgtgtcttatggggtgagcagtaggaggggactttagtctgttcccttccagagccttctgagtgtgagtccaaatgtgcccacaccatggttcccaggatggcatttgcattcaaactgttacccattaatctgtgaaagcctgagctttagacaaacctgagctgccagaaaggaatttccagtgcattcaggtgctaatgagcaggaatgagaagtcctagctaacttcctaggctcttaggctctttcccatcttgctggaacttcctagcaactttgggaggcagccctggcaggaatttttatattttgttttactttgcagctgagtaaactgaagctcagagctcatgtatagtggaattggggcttgactgtcaggcatctaacttgaggccacaaatatccgtgtaaatgtttgactgacttaccttcatgctttgagattattttaatacggtgatgcttgtgacctgtgtctgttggggcttagttccttaagaatcctgattgaaacagtggcctgacacccagcagagatatgggtaatgtacacacaaggattcccaaatgaccaagaaggaaagctctgtaagggagtattaattgtttgcctccaggatcagtattcattcttggatcaaaccccagctccactgtacaccagccacgtgatgctgggtgcttcctcatcatctccacatgtccttttgccatctgcaaggggaggatagtaaccatgactcatctcacagggtgatgatgatgtgtacatgagatattgcaggtaaagatggagatgagaagcgtgaccagttattgtgactacaggatgaaggggctggtctaaccttgagcttgcgaggaaagcagagtaaagatgcctgctgaccctggacaagggttttctgctcagaattgtttgtccacttcaggtgggttcttctggccccctgaggcaagtgtgtgcactgccacagccccctttctgatgctgcatttcttcctctgtgaatggagagattctgaattcattgaatgcattttcatgatgtgatactttaggcctgcgtaccaggaaaataaatggtcccaaccacagttagctcctcgacttgcaggggaaggatgctgagtggaaagtcacattgggaggtagtcggggctacaaaaggggtacaagtcaggagaggttgagcccagaagggagtctcagagaggtcaggctgcgtaagcagactcgaaattttgctataaatgtgagctttgaaaaatgataatcctgccctgggaggagtagtaatgtctccttctcttagtgatccacatgaacctccccagccaagacctgctggtccagaatctaagacaagagaagttcggggaagtgaggatatgaggtgaaacgaatgagaactgttttcacgtgcctgcttgagccagcacgactgcatcctgccttccctgagagacacgctgagagacacgctgcttccatcagccgctctgtggctgttcagcaggatggcgtgttcagccggggagtggtgtgtcatcaacccaatttggcagctgaggcaatgaacacagagccaggaccagacgacctgggggcatttttactcttgaaaagaacttagacattgatcaacttaataggctcatttcatggaagaagtagaaatgcagaaattgaaaatcttgccctggttcatgtagcctgtgggaattagaaaccatgattccaggctcctggccacctctctttccatggagggccccttgtggggatttcttctctagaatgggctccctctgaccacattttgtccatgtgtgaaatccagcatgactgctgatgccttccatgtgtgagtggtggccgtgggcagtgcctgatgacctcatctgatggacattcttttccgtcctcctcctcacccctctcccataacccgggtgcagaaacattcaggacattaaaccctgggaacctcaatttgagataagacctcttatgtcctgtgggtcaataggagtgactcaaacgttatgagaagcacatggtcgcagggcctgtgaggaccacctcagcttggggatgagtccttagttaagcttatgcttgatgttgcaatcttgaacagaaaagggggatgagagaggagagaggacagtagagaaagggggaagatttattttaaagaattatatttaaggaatcaactcacacgattgtggggatggcaagtctgaaatctgcagatcaggccacagactggagaaccaaggaagagctgatgttggcatcggagtccaaaggcagaattccttcccaatctatgccctcacttttaacggcagatggtctgcaaggttgggaattcaatttgcattgtaattcagccactgccaggatgagatcctacttctggttttcagccatctcagctctgcatctatgggacataagggcagacatagaaacttttgattcattcatgtggtgcttgagctgggaatttgaatccctgaattcattcttcttttttcccccactttgtctagtacaattaggagcaaccaaccactctcgttatacttgttaattttacaaaaatgtttaaggtatctgctacacacccacctagaaccttgcctcttagaagcctttgggagtatttaataatattttctgtgtctctattgtcccatcatgccctgtactctcctctttttactactggacgtagaatcattagtgcctttcaacccaatcagatctgagaacgaatttcagaaacctcagaacccattcagaaaactcatttttaagatgatgttcttctagaaccactcttgctacgaaaacctgacagcacagtccccaggctgtttgttagggtctggcataaattcttggaaaggcaaaggagaatggtgagagcgtgtgtaactgtctgtctgtctgtccatcccagttggttttcactgtgctttggtggctgcatatggagctacagatactgatttcccacagttcccactttggatttgttctcctgcttctcgtccatgggaaatgactgccagagctgggagctatcaagcatatttaaaccgcagccttccatttattcttcatgaatgcacacgggccccagactggttgtaaataagcaccagctcccatcccctgcagttcttggccttatagagagcctgccagaggctggcttggtcacatccttcagtttagactttacctggagaagaaaatcacaaaggtctaacgggcacccagatagcatcagcagtgtatttagagaagtgcagaagggccaattaagcccatttcgtggtttattattattagtggtaattatttctggcatgcagttcaagggtgtctgtggcctggctgagctccggaagtgcatccacagcaccctcctgtgaatgtttatagacccaggaggggagccctgggttgggagctccagaccactggggatgggaggcagagactctatgtatagatcatactcttgtggaggtagaggcctggaacatgatggctaaactcctgtcgctgattctgggctaagaaagaaagaaaatccaaaagacagcaaggacctctgaatccctgagggaagttgaacagagcaaagtagaaatgaaccacaggatggctccatccctcccctggcatccactgcccctgcccctgaatgtccctatctttgcttagctgtggcccagaagtccactcagcctttgtctaaagaggcaggttctgctcagcagtggcgttgagagctcagaccccattttgggttttctagaggcagaaggccaagttcattctcttgaagtgaggtagatattcctgtgcacagagagaaggggaatccagctcctcatagagcagctccccaccccaagctgagttgtgtttcgcagggagagataagcctgtggtcagcagcattcatccccatggtattcaggccactttccaagaaccagcccctccttgtacttaagtttctagaggcagggccgaggagcaggcacagggagaggatgagcgtcggcaagttacaggaaactcaggaaaatgtttatgtgtgtccagggattttcagagactatccagccattctttatctccaagtgcctctgctctcatgaacttcttcatgtggacaaaagcaggaagcctttagggccacgcatctcttgttttcctgtgacttacacagccctcacctttgtgcttagatggactgtggccagcgggacctccaggcctggctgggtcaggagagttttgcttaaccagatctgtttgatccttgaaccaaaagcggggagccagagagatcctttgagaactgatgactgctgctgggtcctgcccagccatttgcattttataaaggtctttggcagcggccaaggccttctcattatgtggtgtttttccacttcgggatgaaccggagtggtttgtgcagccacctgatagctctttgcaccagcttctgcatgggagactttgagcaggccaggagccaaggggaccctcctaggccttccgagcacctagcactggcccttttcttccttggggcttccttctggaggaggtttccctgggtttggagtcctccctcctgctgggggtgggggcgtggttgctggtggcctggagtgagctgcctgctgtggcctccagcactccccagctgaacagcgagtcctttgtgaaattcctgaggcaggagggggcagctgtgcagagccagctctcagagtggccgacagggagggtgttgtggtgtatcatcaagtgataaggccttcggaaaggctgtggagaggaaggaaaacacattcctgactgtggtgtgtttgcccttgagggccctgtgtttggggaagtagagaagcttggctgcattgttgtggggtgggagttagccctgtgctggggggagctagtgagagatgaattcagctgacctgggatcaaattccagcttggatgcctttaattaataacatattagaccatttaatcaatttaacacacgtttttggagtgcctactatgtgcaggcaggtaaatgatcttcaaggtgtctccatcaggtggaaagtcaaaaattcagaactgggcaatgactggaggggaggatgggattctcaggtgaagggtgtgagacccgagttgtgttttggacgatgttaaaggaggagatcagcttccagtagtgaagagcatctgatgctttggtgaggaggattttcttttaagtccttgaatgcagaagggctcctttggaagattttatgcaagagaatgccatggaaagattatattatagtggatcactctggaagtgtcatgcggaatgaatggagaggtaggaagcggggttgggagagcaaacgtaaatctaaggtccaattgggaggctctgttggaatgagctggcgagagatgatgagggcctgatttaaggaacgattgtattgaaggcactaaggtattggcattcagcgaatgtacatgagtctcaactttctggtttacatctgaatggacagagaagaggacatgatctgagcatcagggagttgatgtttgtcttggacattgcattaatatagttaggctaggcttccagaaactctgaaatcccagtggcataatgtccagtttgtttctctctcacagagtcagctgtgaagatggtggctgtaacggacagcttcttccaggcagtgactcagggatccaggctgtctcttgaggatatctggggggttatgtatttgccctgaaatacttcgccctggtgatgtcatgtgtgatttcctcccgcagacctttagtcagagctagacactgtgaagggctaggaattgtgaaaagattgtgtgaatgaacaggaaggttaaatttgaggtgccataggccatgcataaagaacagtccagatggcacctgggaccggatgcctggacaccatccgagcaggagattaatggaattgaaaatcagcaacgtaggagacagaagccttcaggatgtctgggatcctatagggagggtgtgttgtttgaagagcaggggctgaaggtggaatcttggggagctcatgacaggctggcagaggtactgaatttctccaagtctcagtttcctcatctgcgagatgagcctgatatttcctataaagggatagtgagtgcactgggtgctgctgggcaggcagtggctcctcataggggtggttcccttccccctgcattgtgttggactgaaccttgtgtgttctgtttgtcaggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctggtgagtcctggcgacttgttcacacttcacattctgtctttcttcagaccagactgacctgttaggcgaaaacaacatggtggccaagagcagccataaaactgggagacccttgttcaccaaactaggttggctacatgagtacagggaattgtcattctagcaccattttgggaggggattctggataaaaacctgggccatgttgaaagtcaagccaagaagggagaggaggcgtcaaaaggactccacttgggttggtgtgatgccattcatgagacagcccaccaaataggtgtaggcgcacagcatcttgacgaagctgcagcaccacgttatgcattttctttgcagtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtaaggagcgatggcctcactccttggtggctctcagccttccttgtcctcctcatctgggggccatggggctcatggaggccttgaaatgacagacagtggaggacatcctagaagccagtacttatatgacaatatttctgagggttggaaatctaagacctcttctaataggtcatttcttcctaaatattacatatatatttctttttaaaacaatttttaaatttttttcagacaaggtcttgctctgtcaccaggctggagtgcagtggtacaatcatagctcactgtagcctcaaactcctgggctcaggtgatcctcccatctcagtctcctgagtagctaggaccacaggctcagaccaccatgcctggctaattttttttttattttttgtggagatgggggtctcactatgttgcccaggctggtctcgagttcccgggtttaagcaatgcctcggcctcccaaagtgctgggattacaggtgtgagccaccacgcctggcttacctgtatatttcttatcattatcatcaatggaacagtaaagactgaaaacctacacagctttagatgtgactctgggtcagtcaggaacaaacttccttagcaaccaggtgacttactcagttaatcctcgtctactcttggaaatgggctcaatttccttaaaagtgtcttttagggctctctggacttagcatgtcttctactgccagcttccagtaggcctgctatgaacatacactgacctttagaggatctttgggctttttcattttaatgttttaaaatatattaacagaataggttttctgttttttagtgaattgtttagattatatgaagaatatatccttatttccagaagaataaggaagtaaataaaagtcactgtgtttcagatataaccacaattaacattttggcaaatgtctttccattttttgctactacacaggcacacacatgtatatgtgacatgcgtgagtgtgtaaataatattggcatcatacagctgggcccactcccaggttcatgcctataatcccagcattttgggaggccgaggtgggtgaattatttgagcccaggagttcaagaccagtctggcaacatggcaaaaccctgtctctactaaaaatacaaaaattagtgaggcatggtggcaggtgcctgtagtcccagctactcggtgtgggggaggcaggaggatcacctgagccttgggaggttgaggctgcagtgagccatgactgggccactgaactccagactgggggacacagtgagaccctgtttcaaaaaataataataataataatattggcatcatacatactattttgtagtcttttttaaaaaaaattttatcatggaaatatctccacctgcttaaatatacttgaaaaagttgatttataataacagactcttccatgtgagtgctaaactgggactcatttatttatttatttatttgagatggagtctcactctggagtgcagtggtgcgatctcagctcactgcaacctccgtctcccgggttcaagcgattctcctgcctcagccccctgagtagctgagattacaggcgtgtgccaccacacccagctgatttttgtatttttagtagagacagggtttcaccatattggccaggctggtctcaaactcctgacctcaggtgatccacctgccttgacctcccaaagtgctggcattacagatgtgagccaccatgcctggccaggactcacttataattctttttttttggctgggggagacagtttcactctttccccccaggctggagtgcaatggcgtgatcttggctcactgcaacgtccgcctcccgggttcacgcaattctcttgcttcagcctcctgagtagctgggattacaggtgcctgccaccatgcccggctaattttggtatttttagtagagacggggttttgccatgttggccaagctggtctcaaactcctgacctcaggtgatccacccacctcagcctcccaaagtgctgggattacaggtgtgagccaccacgcccagccacatttatgtctttggttgaacatttatgttgtttctggtttttttttttttttaacttgaatgacatttttataatagacacattcttgattatgtttgtaggagaaatttctacaagtggcattgctgggtcaaaggatgcatatatttttaacatttttggtacatattgtcaaagttccttccagaaagtttgtactgctttatacgccaccaccaatatatgtcattccccagtgtcttctaccacctgggtgtcatcagcaaagatccattgtttgctgatttgataggtgaattttgtgtcttattgttttacatttaatttattcaattactgattagagtgaaaattttttcctatgcttagtggccatttgtacttttttctccctcttaataccagcttatttcctttgaccagttttttactggatttagagtgggtttgggaggggaagcacttgaggaaatgtgattggcacctaaaaccagatgtggggcggagacttctaggttggctagactagaagatgacatctggccaggcatggtggctcatgcctgaaatcccagcactttgggagagcgaggtgggagggttgcttgagcccaggacttcgagcccagctgggcaacatagtgagatctgtctcttaaaaaaaaattagcctggtatggtggtgcatgcctgtcttcccagctactcaagaggctgaaagaggaggattgcttgagcctgagaggccgaggctgcagtgagctgtgatcactctactgcactctagcctcaatgacagcaagaccctgtctcaaaaaaaagattaaaaaaaaaaaggaagcctagatctgtggctgtattttgttgaaaaggacagccaattgggccaaatgatatttcctaaagagggattgccacccctgcaaattaaacgaatttttttttgttttgaaataattatagattaagaagcagttgcaaagatagtacagagagaggtcccgggtacccttcacccagtttccctcatggttacatcttatataaatgtagaacaatatcaaaaccaggacactgacagtgtcacaatgtgtgggtatagctctaggctgtgtggccacctgtggagtcatgtgaccatcaccacaatcaagatgcaggtctagtccagcatttcagagaccaacctcttgctgctcctcccctccaccctccctaaccctggaagaacccatctagcccctcatctgttctccatctctaccattttgttatttggagaatgttatagaaatggagtcatacagtgtgtgacctttgagacggtttgtgtttcacttggcacaacgctcttgacatccatctaagctgtcgtgtgtatcaatagtttgttattgaaaagtaactttttaactcgtttctgctgtgtgcctcctgtgcacacctatgctgtctccctcaggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagcgtaagacctgttaactgtgcagaccccatccaaacgaattacagtcacagagacacagacggagggagagccccagggtttctaaaaagaacttgctgtgatgggaatgcgctcgactgaggatgttatgatttgcaatttgctgggaaaagaatagttatttcattttctttagtgaggtcaataagattgttactctcataatcattttggaataccacagcctctctatctatagacctttagagcctctaaagtgatgtcaggatgtgcaaagcttccagaagtcaggcaccgctccattttcataggttggcacagcacttctcatggcagtacttggtgcaagggacctcaatgaagcagtgagatgtcctctcctgagatgcccactggggactttgatcctcttaagccattgttttctcaggccagtatccatgcagaaaactggatgacagccattcttattatcttaaaggaattgattgactgacttctccctaacagaagtaccccccagccatttgattgttgttttaggatctgccgctttgggtatctcttccctctgggtctgggctttagagcttagagatgtcctctcttgttaacaggacccagggcaagtctgttaatgtcttacgctcctcagctgagagtgaggggttcagacgaggtctccaagtgtcctgtgattctgtgaggtcagcagacattaagcagagttgttagacactgccgattcctcacaagcaacatggtataggcagaaaaactgaaggaatatgcccagagggagagctttggaaaagaaatgggcctcgggcagaagagtttcgtgtcaggaactcatttgaatcttgaagacagctcaggccagcaagcactgacacctcccccacacaccacgacagcttagggcaggtttctggcatttctccgggacaaccctgggactttgccctgtcccagtcctctctcatttgcacacacagaggtgtttgggctgcaatgggctcaggctcagctctggcttctgccacctgtgaggaccagggtggtgggtgtttctcagaagactgttcaagtctgtgtttaaagctgtctttctccctctcccaccaccactcactggctcagcctggcagcgcagccttatgatcgcgccccttacagcccagatcatgacttcttgggtgtcctgactggctattttatggtcagggatcctagggccctgccccatgaacctccctattcatgtgcctgtaacttcacattctcattgactctttcatttgaccttctcaataaagggactggtattattatcccaatttgggaaaataaataaacggaggcttagagagcttaagtgaccagtctaatgttacatagcgattttgcggttgagccagaattagaacccaaaattgttcaggactcttccctgccagactgcatatgcagcctcttggtcaggcttagacggggaaaatgcttcccctctcttgcaaggttgcttcccccagaggtgctataaatggctggctgggctcgttatttaagacacaaatgacctagctggggaacttgcatttggagttcttaacctagaagacgagacagtgggaaggagagaagatttgggaagacagattctgccctccagacattttcaccccaacctaccctgcttttacctccaggtgacctatggaagaaatgttgactttcaaagcggtgcttttccatccccacctgttttaaagagccagcactaagcatgtgcctgttcgttcatcttctgggaaaatgcaaccaggagactttccctgcatagtacagtgtttcctaccatgaggctaattagctttagttcagagcatctagctaactattatcgacagccctgttgctaagcctttgcttggattttccaggcatctggcccgatgagtaattttagggagcctgtgtggatgtaggttaaaaatgtctatgcatggtgagtgaggaagcctccctgcatcatggtttgatggagagtaggctctgagtatctgggaattgtgatctgacccttggacttgtcaatgttaagtcactgagagtcatggggctggttcttccatcttttaaaaatgatagatggccccagaggtcttctaggtgctcatttataagcaacaagactcaacgcatgcattgtgtgagatcttggatgctgcagggctggcaagtgttagcaaagtgcaataaagagccagacagtgaatgagtgaagattttctaaatgcctactgtgagccaaatagtgagctagatgcttttgttcattttatttcatttgattctcacatgagtcctgcaaagggggacctacttacccctcacagatgaggaggtggaggctcaggggtgtgagggatgcatccaaagtcacatagctggtgaatggcatacctggggtgtgaacccagggcagatgtctccatggccgaggctgcgcccatactctacccagtagggcacaagaggaggttgtcagggcataaactgttagctgtggagtgatgtggaagagatggctcttgatccaggccttaaaggatgactcacaccctttcaaaggttgtttctgagatgaccagggatgaggctttttgtattgtcatcttcacatacacctcgggagggtgcagatgaagaaactgaagctgagacaggattaaagcaatctccccagagtcacacaacttctggattttaccgtatctgagatgccatcgattttaagatattccattaggttatgtaccacgatgaaagaaaacatgcccaagacgaggagtctcataggagactgggccaccaagggccagcgtgtgcttattatggcatctctggggagaccatctgctgtgcagacaggggtggcagaaaatctcgcaggcctcgaccttggcattggttgccaagagggaaaaatgtctcccccaagaattggaactggaagtgggtgcttgtccagccttgtggtctgaatgcatgccgcctgtgtggtccagaacaatgtcaagctgagaatttactgtaaaatgccctcagtggggttgtcccccaacccagtggcacaaacaaacccatatccccctagaagaacttggatttagtctaggctggcagtacccgcgtggctccggctgctataagacacattctgacttcagggatgagtgtcttagaattgatgaaagacaattttaagtcttgggtctcagtaatccaagtgcagagtcctcttccctccctgctggcgcctctctgctatggttcctttggtagcttctgcatgactgctttgagactcagagcaatgtactgacagccctcgtggttgttttcacccaacattgtatgcggggcattgtgcatttacatgcctgatgtgagctgctgagctggccgaatccgtgttaccagccgctgcactaagcagaaatgtcatcttgaactgcagggtgctagcacagctctctgttcagaggccagctccctgagtgctgataacctggtctgaactttcccagaagcccagggtgctttttatggttggagcaacctattaatcctctagtccagactcagccacagccattggtccccgtgaaccaaacaggcaggaagaagcgggaggcatttgggatctgggaagtagcactgggttagcagaagctgcaggatggaatgactcctgtgcaatgactcctgtgttctgttgcttcattaccaaccacaaactcacatccatatggagaccccacctattttccaagagggcacacagatatgtctctgttttacccggaaaaacttgaaaccagaaggatagctacatagctacattgttctggaaattaactagccctcaatcattttatcggaggcatgtctcttcagtgaccacaatcctttcatttagggacttcagtttaaccacaccgcaaacagactagaaaaccaggctagccagtgggaaaacctacttgtggatggctcatttcaagattaaatttagaacttggtcagagaaggcctttggaattcaaccggaatggagctggagatggtgggaacacagtctctgttaataggaagaatcattttctttatatttgtgtagcatttacaaacatgcacccttttcacacaattattctgtttaattatttttctttctaatgtggagaggtagaaaaagttatttcatattctagacagggaaatggagacacagcaagtaagtgcctgctggggtgcccagttgggacaggatccctgtctctgagtctctcttttgtctctgtggggttggggcagtgggtgctgccgggtggattgagtccagccagagtggcctgttctagagtttactttgccttcttctcagtctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcagggtgagtagttttgttctgatgaattttttgttaaatcacgaattaagttcaaggccacaaacatttattaagcaccttgagacagaatattaagatgaatttagtggattccagggataagagggagcctgaattttttattcctggcatttaaaatactggagaaggagtcagtcgtgtccacagagagccctagcaaagtgagatcatggtatatgctatgataaggagtgtggagtaaggacccagaggagggagccactgctgtagttggggagagtgtcatggggagaggacattttgagttgggctttgaaggttaagtaggagtttgtcaagtcaaagaagggagatgagggaatttgataagagtatcatgagcatagaaaatgtacagtgtattcagggcatgtgaagcaggaaagagatggagctataagggaattaaaaggagagaatgcaattggaaagaaagtttggggccagatcttgaacatgataccagatccgcctcacagcatgcttaggggattcttacagggtttaaagttgaagtgtcttgggggaaaaattgtaaggtgtgttagtttttgtagagttaaccagttactggaccttgtggggagttttggcctggcatggtgggagctggccccacacaacacctgtccacctgtctgtaaggagagccctccatccctagatctcacaggcccatcctccctccaggagggtttctagagaggtatcctctgtggctgtggcctgagctggggggactcttgtgttttgcagctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtagggttggggcttggggagggcacagttctgcagggccagctcgctggtgctggcgaggctacagttgcatttggaaaggacacagaaatagaagtgaatgatattccctttctctccaacgtgagaaatacagtggactcagatctctggagatgtattttctttttcttttttttgaggcagggtctcgctctgttacccagactggagtgcaatggcacgaccttggctcactgcaacctccacctcctggttcaagtgattctcatgtctcagcctcccaagtagctgggattacaggcatgcaccaccatacctggctaatttttgtatttttagtagagacggagtatcaccatgttggccaggctgatagaactcctgacttcaggtgatctgcccgcctcggcctcccaaagtgctgggattacaggtgtgagccaccgggcccagcctagcttggcctggagatgtattttcatagttaatgactggttgggtttcagaatcttgagatcagtttgtgtcacacaatgcccatactgtgttttacctaatatattaagaagacatttgttcaatttattaggtccatcataagaaaggacactgtggtatttcaggacttctcttctctcctacagtatattgtagtttagcttgtggagtttggagtttcaacagcctaacttcagggctcagctctggctgtgcttcagtctcctcacctgtataatggcaataatagtagttgctcccccgtgaggttgttgtgagggttaaatgggttaatatatatgtacagtgcttagaatggggccatttgagaactgttagttgtatttgcttgggtaatttgtgtgatatccccttggtgagaggaaagggttcagatttttaagtttccttgcttgaaacttctttcccatctttcatttgtcccatgactagaacattccactcttccagctccctgggccacagattcctatggcgtattaaagaaattgttaaaccagagagaattttttttcttggtggttgtatgggtttttagaaagtaacctatgtcccatatatggattaccagttttcaaaacatttaaaaataaggaactttactttgttgtaagtaaaacgtgtataatcatgtctgtgttttctgatctctcaaagctgttccaatataaggtgccatcgttcctcctacttgtgattatatgtgtaggattaggggattagaatgccagaagagggctatgtcctcagaaaagccacagccaatttgactaatcagaacaggggacaggacagagtctaagatgtagtgatattttgtatatagttttactttctccagtaatagatccaacaacctttatacagtgtctgattctttggttaccttaggctcatctcctttttaaaaagtttatttttatttttagagatataatagtatctcactgtgtcacccagtacccaggctagagtgcagtggtgcaatcacagctcactgcagcctcgacctcctgggctcaagtgatcctcccagctcagcctccccagtagctggtactacaggcttgcaccatcacgcctggctaattttttaattttttttttttgtagagataggctctcactgtgttgcccagactgttctcaaactcctggactcaagcaatcttctcacctcagcctctccaagtgctgttagtaggattccaggcatgagccaccatgcctgctctccacctcccttctgtagtctaaacttcagtgaggttttaagagaagaacaaagaatgtgaggccgggcagggtggctcacacctcttatcccagcactttgggaggcagaggtaggaggattgcttgagcccaggagtttgagaccagcgtcagcaacatagcgaaacccctctttacaaaaaatttaaaaattagctaggtatgggggcctgtggctgtggtcccagcttcttgagggggccgagtgggaggatggcttaagcccaggagattgaggctgtggtgagctatgatggtgccatagcactttggtctggaaaacagagcaagacgctgtctccaaaaaaaaagaatgcgactagcacttttcctcctgagctgtgagatttcaccttcaagcaggatcttgtgtgactgtcctggcccctcacccgctcctctcttctcctctccctccaggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggtgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcagg

SEQ ID NO: 198 - DNA, 63426 bp, Homo sapiens; identical to SEQ ID NO: 153

SEQ ID NO: 199 - DNA, 7700 bp, Homo sapiens
acagacactgatctcagtttcccccgagagtgtgagtgtaggcctctacaggcagctgcctctggggagttggggagcctaggggttaactctagacccccctcaaccctctggaccaaagtctgtccaggaaaataggatgccggagcccaggagtcgtcagcctagcagttgcctggcctccagatgcctcccaggtaataatgccctatcactctccaaagacttccaaatttcatcctacgccaatcttgtttcatgccctcaccaaagatacccctgtgttcctctcgtggctcgaagtacgtctgcctgaggctcgctgtcctccctgacagcctctagagctggctgagagctggaccttgacattccttctgtttccttgaccctgttaccccttttcaaatttacttattcgatacatagttagtgcctgctatgtgccaggccttgttctaggctctgttctagttacagaaattaaaaaacatttatctttcctcataagcttacattgtagtgggctttggggaggattttaatcttccctatttagatctccctttcttggaggggtgggtgtatccaagtgtgggcaacactgggaacagtcataacagggcttcccttcttcccctttaggggagcagatcctagcatgggccccaggggtgaggaagggcctggaaccagaattgtctggaaccctgatctgtaccaactttagggtcaccttccagccctgtggatggcagtggaatcaggtgagatggttggggccacagaaatgacagctagtgggaaatgggtaggggagtctagcaggatttagacaaacattatgggttaagggctgtcttttgaatgtatcattgataatcagtgggaactctctctagggttgttgccccctagaaggggttggggctgccagggtaggaaaatgagggcgatttcagatgtctacccagtcacgtgtttcgtctaggacactcccttgaacagtgaatacgattttgccctggtcaacattggacgattagaggctggtaagttgggggggggtttggtgaaggggttcactggggttgttggaactccctcctcatccttcctctgttctcagaaaacagcagggatggagtgggatgggctgcaagagtcccttctggagagactctggtccatggttacactgttctgtacctcttgacttcagtgagcggcttgtcccgagtccagctcctccgtccagggtccctgcataaatttatccctgaggagattctgattcatggccgagacttccggctgctcagagttggttttgaggctggaggcctagagcctcaggcttttcaggtaagaggcccctaacctgaggctttctcctcacctcagaaccttgggatcctctccctgacaatttctgagactcctccagcccctgggatcctctcatcattccccctgcttctctcaaggaaaggctaaaaggctgggataaatgattgcgtgatgagagtaaagagcctgcgctctagccttactctattaattaccagcagtgtgactgtgggcaagtttcctcctctgaaaaaccaggattcctcccagaatcatcattctaggattctgtggttccagatttgttctcccgaccccagtccccatgacctgaggaagcccccttctctagggactgtcttcactgttcttcttcattcttggcaaagagagtggagcaacacatgggctccatttccttcttttcacttactcagcctaagccaaaaggatggaatgtcctttcctctgcaggtgaccatggccattgtccaagccagagctcagagcaatcaagcccaacagtattcggggataaccctgagcaaggctggtgagtgagagtgctttagggtaaggaagagtctgaaaaagcagaggatggctgatgacaaagagctgagaagctgtctctgattttctccttcctcctctatgtctcactcctgttctaggccagggttctggctccagaaaaccaccaattcctctcatggagacagcggaagactgggagactgagcggaagaagcaggcagccagaggctggagggtcagcacggtcaacgagaggttcgacgtagccaccaggtgatcccccagtgcaccccaaccctgctgctctcccaatcttcccttagttccttgatcctctaaagctaggacttcccacaaactccagcctcctaggacacccacaaagctatctcccttgcctcctagatccctaaacctgaaatcccttggaatggtccctctgaagcagcttccttgtaataagagctttccattataatgaagtcactgagccaaactgtaatatcactctcatttcacagcctcccccgttacttctgggtccctaaccgaattctggacagtgaggtcaggagagcatttggccactttcatcagggccgtggaccggtcagtgtgatggttagggtaatggctgtggattagagggtcatgtgggccagggacatcgtggagggaggaacctctgtgaggtcagtgtgggggcaagggtagcgtggagctaggcatttctcccacaatgaccctcttctgccccatgtgaagcgcttgtcctggcatcaccctgggggcagtgatcttctccgctgtggaggcttctatacagccagtgaccctaacaaggaggatatcaggtgagggaggcttgatgagaagaatcaagggttaggtgctcagggtagactccttatttcctgactccctcccctccagagcagtggagttgatgctccaggctgggcattcagatgttgtcctggtagacactatggatgagctgcccagccttgcagatgtccaacttgcccacctgaggctgagggccctctgcctgcctggtgagaataacctttgacccctaaccctcaccctcacccctaggtctgctgagcctaacctggtttaccctttgcttgctgtagatgagtagctctttagtccaatgagcccgttttcttttcttttcttttttcttgagacggagtctcggctgggcatggtggctcacgcttgtaatcccaccactatgggaggccgaggtgggcagatcacttgagggcaggagttcaagaccaacctggccaacatggtgaaaccccgtttctactaaaaatacacacacacacaaaattagctgggtgtggtggccgatgcctgtaatcccagctacttggaaggctgaggcacgagaatcgcttgaacccaggaggcgggtgaactgagaatgtgccattgcattccagcctgggcgacaagagtgaaacttgtcttaaaaaaaaaaaaaaaaggcagatgagacggagtctccctctgtggcccaggctggagtgcagtggcgtgatctcggctcactgcaacctccaactcccatgttcaagcgattctcctgcctcagcctcctgagtagctgggattacaggcgcctgccaccatgcctggctaatttttgtatttttagtagagacgaggtttcaccatgttccccgtgttagactaggctggtctcaaactcctcagatgatccacccaccaaggcctcctaaagcgctgggattacaggcacaagccgtcgtgcccggccagtgagactgttttctactcacctcccacctctcccacctctcccacagactcactggtttcctgtcttcttgaccccaatttattctttaaacagctttattgagacataatgtacataccataaaatttacccttcactgaagtatacaattcagtgagttttattatatttacaatgttgtacaaccatcaccacagtttaattttagaaaccatcctggccatttacaattacttttcattcctgttcttaacccagcaggctatcaacctgaatcctgaatcctgagttctaatctcttgcccttctgatctttctaccctctatcagattcatctgtagctgaggataaatggctttcagccctggaaggaacacgatggctggactatgtcaggtactccctcgcttcttctagccatcatttataattcaaccttcctcaaccttctgttaacttggggtcctaaatggcctttctttagttcttctcctcggtttcccaagaagactgccattttctgctctttagaaggaggaggggtaggatttggagtcggccttattccatcccatgacccatcaaaatcactccattcccctaggcttatcattcttcctccctcttcctcacctgctcctccagggcttgtcttcgaaaggccagtgacatttcagtattagtgacatccagggttcgttctgtaatacttcaaggtgagttccttggttaagcccattccattccttgcctcttttctttacccacctgaccagattgcattcagggagggagacccataaggcttcttcctctcctgttcctgggaactacctgcgagctctactctcatccttcagtgctacctctgcctccccatcacaacttgtggtccctgacactaggatggtcttagcccctttgttcctttccttccatcagcggatggagactggggttggggtgggaagggcagtgtggaagctggtttgagaattgtgattctgccccttacatgtgaaactgggtatttctatccgggtggagtccaggaagtgaatcattcaaggtctttgttttctcttcacttctatgtgctttctcaatcctcctaccccaaacctttcccctctgtgcctctcacttctccttgccgtatttctcttctcattctcttctgccctagtttcttggacccctcttctttgtcccttcttcctctttatcacccagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggtgagaatgattcgggatggcatcgggggcatattactaaggaagtaagagaatgagaaattattttgtataatccattggaggtgaatccggtcagaagggccccgaggttaggctgggacgaagatcctgatgagtgaggccttacaagcccctgctaccctcaattcagattttcattccctgacttccataagttccccctattccctgtgttccccattcccttatcatctcgtcatcctccctctttgggtcccaataatcccttccaacctcttaatttcttttcaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacaggtgaagtgtctaaacttcctaaattcccttgacgttcccacaggctcatgctactagacagtgagaagtgaaagacaaaatgtcttgagttccttagggaaagctactccactactcttctgcagctgtcacttatagtccctgggtgtccctaggaagacagaagacctagaatagcacagagggcaccctttttgtccttcctcaagtctgtttactcatcttcctgtctcgtgcacacataaggtgccctaaaatcaaccttaatcagtcccgaggcctagttgaagcctaatgaggagggtagaagagttctcatggggaggcttgtagttctagtcaccagtgcagtgagtgggtggcagcaggacaccctgtcctgatccagattggggaaactagggttatctggtctctctgttgccagttgattttcttttccttttagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacac

SEQ ID NO: 200 - DNA, 6237 bp, Homo sapiens
gagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggatgaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataagggcatttgtttcaatgaaaaagttagtgttaaaggaagtgagtcagggagggcggagtttgttgtaaggcaatcacctgtcaaaacagaaattgggtgggaaaggagtctttatcttggggagcaaaagctgacttttaaacttgacccctgctgtttttaaacagcttttccttttggtctctgacagtcaatccaggttttatgttatttcaaaagggttatttttgtcctccttttttaatagcttcaggaaagttaaaggtatcatcttaggtctaacactctagtctttgagagttacggttctttcgtagaacaatttccatgttgttaactgttgtagacttaattgaatcacattttgggaccagatgtatttggggatagaattctttaaatgtatgggacttcatgcttcctgattatgtaatatttcctgtggttgggaatcctagaatgcctgatctattttatctgttcaggtagttttgttattgtaccctcttttgggtcatattctagtatttctcacagggggtatgagaaacagaaagctatatgtagcagctggtcttgagaagtagaagcatcttaactgtcataagagcatagattttttgtttttcacaacagctggaataagttcctgcattataagtataaagggaaccgagatttaatttggagatcatcactgttaaaacgataccagacatttgtcacagtgtcttatttggggaaagtttgctaatatacattttgtctgtgaaaatatagtaaattttaaaatactaatataatgtggtattcttgattacagtattttatgcagactattaggaatgattcagtgcatttaactgaacacagagctagttctaggtgagtgagatctttatctattaactggattttgaaggtttgagaaggctatggggatcatctggttgaaaggttctcaaacttgaccatatatcaaaatcacctggagcttaaaacatgtactgctgggaccctcctccagtttcttacccagtgggtctcgggtagggtctcaattttcatttctaacaagtttccaagtgattgtgttattgctgttccagggaccacactttgaaaaccagtgatctagactgaactccaaatgagtactatactgacagccacctagatattgagagacacagacttcagactcatgtcacacattttggagtgctgtctactacagttagagaataatctctattgaaatctaagctaaagaggacatataccatttatactaagactaactgttgtgtgtgaaatagaataaacattgcaggtagtttttgatcattttcacattattacaggaacattttgactatggttttcaatgttaattcagaagttgactttaaatgaaaatgtggttagaatagaggcaaagcctaagtgatcagaatcaacattccccttctccccaacctaggggaaaaaaaatttgaaaagtatgtcttcaataaaaggggacactttatttgtcttctcttcaacattaaaaaacaaagattttaagttttcatggcaagggttctaaaaatcattgtgccagagaatttaaatcttcatatcatggtaagcacatgcgtatgtctgtgactcagtttcttagccagacttccaggtgttagttaattccttctcatttagttctactgtaatccattctgggaaaatgcataccacaaaactgtgtatcttgcagcttctttcgttatgcatcttaattccctcagaaggtcccagaactttatgttaaagatctgggtttttaaagacaatttgggggccttctaaagaaacaatagtagatctaattacaagtagtggattgcttacttcaaatttctcttttacaatttagaaagtttagtaccagtttatagactgagggagtagtagctactatttagatgctgagaataatattatcatgcttgggtggggaagaaaggcccttactcaaatctccattttcatttttaatgcttcctggacttcagttattttcttgcttttgcctcaagaataataaatatttttggttaaaa

SEQ ID NO: 201 - DNA, 132334 bp, Homo sapiens
ataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcaggtaggttttttttcctccccttttctctctttttatccctttttggtgtgctcgtcctccatcctccttttctaattttctcattttgagtggggatgtgagtctgaagtgagaaggggtgtccgtgggtaggaatttcaggtgggtttagctcctttatggcaagcttttctcaagagtggcttcttcgctttctcttacactcacactctctctccttgcttttctctcctttttccctcccccaaataatttcccctgtacctgttcattcaggtaaccaaaggtgtcctttgctatccagcccaggaaaagttttattgagaattatatggctggaataaaaactcatcaaggggagaggtcctgctctattttcgcatctagttccaattcattatattcagcaattaggacttggcaaatacctgttaataattacaaaacttggtcagttacagacctacaaattcgggggcaagtctttctcttagacatggcagttcatcctctcccaccgagaaggctgttttctaagcagaaagttgtctgtttttgtctgcttagcgagtttcatttctttatttcattctttgtgtgtgtatgtgtgtgaagtaacacctcacttctgtgattataaataaagaagtgaaagtcctcatggaacttgagtcgtttaccaaagtggaggggggggcactacagctgggaagaaaactgctgtcaggatatcagggttttaaattaggataacttttaaaattgtatttttagtggcaaagtaatatagacatggatttaatagaagacacatacacacatatatcccattccatactttggcactgaaaagtcgagagagagatagcaggagttcccaggaacagtgatgagcccggctaacatgaatgtgtttatctcccacctactgatatattttacatgctccccctgtaatgatgaaggcaagattactaactccagacttaggagtaacaggcaaagataaagtttacagcacaaatgccctgtctctctctctcacacacacacatgcccataaaactagcaacttactttattaaacatgtatttatatgcagtcgtgtgtctcaggatgaatatagacaggccagctgtttcatcccagacacttgtgtgaccatttctttatttcaggatttcccctaacaatttcaaatcaataggacaaggaaagaaatgataaaatatgtcaaacttaaaagtctcctactatgtatgcctaggtaaatttaaggtgctttctaaaatatccacttccccttctctctgcccccctcccttcacccctctcagcaaatgtgtggaaactgatactcactttccaggttttctgcaaagcttctagcacaggagacaataggtgtggggcgtggggactgagtgtgcccggcagagaaagggttaatggcccttgtgttacagtttgcatctgttacatcttttatagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttaggtacaaaagtttcgaagccagaaaggatacgatcatttagtagagcttaaaagtattgccgtagtggttggactttctctttcctttcttaagggaaaaaaaaaattctactggaactatttaagggaaccagtgtgggggagcatgtgtgtgagtgaggtggggggaaatacttaagtaaatattgtcaaagtggcgagggggggtggggtaaaggacagtgtccaaagaggcttataattatatttatcattgcggcgtaaaacgggaaatcttaatttgggggcgagggtggggggaggaagagacagtgcctcgataaactccaaaaggggaggggagggggcgctgggcgagtgggcttcctataattactattatcaatttgcccgagtgtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacagtaacaaacacaaagcgcctcggggccaaggctgggggtggggggcggggagggggccgccgaagtttcgctttggcgttggggggcgcggatgggtgctcgccggggccctggcccggctcccctgggcggcccgcgcgcgtttcaatgggcgcgggcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacggtaagaagcagcccgaaccaaacttttccgggccactacgcggctcgagacccagggagaaggagggggaaagggaaaaggaaccgaggcggcggcggcggcggcgcccagggctctagggcgagcctccctccgcggccggcgccggagcccggcgcgcgcggcggctggaccggggggtgttggggaagtgccgggcaaagtgagcgtcaggcacccgggggtccgagcgcgggggtccggccggggccccgcgcccccagccccgctgcccccctcgagcccctgcctccgccctccctccgcctccgcctcccgctccgctcgcgcccggcccgccgggtctccggccgggcttcgggagcgtccgcctggggcagggcgggggcccaggcgctggatcgcgcaggatcccggggcgggggcgggggtggcagagagactgcgaaggcaggagaggggaaccgggtctgcgcctcagcgaggcttaaagtttcttgccggagtcgcccggccgcttctcggtgcgccaagtaacggtccgcgggcagcggggcccggcccatcgcgcccagaccccggggtgggagggagtcggccggccccgcgcggggtccggtggggtcgatgatggctcggggacggatgactcctctccagcaggctctgcccccaggccggggactgaaggagtcgcagggcgcagcgagacttttcccggcagtttctacatggtctggaggagcccgttatccaggctgagtcaggaaggaggaaggagaaaggagatgggggttcgaggggcacacgcagatcagaggtgggatattaaaggggggggtgagagtttggtaggtccgttttggagacagccagagaagggacgcggggggacagagagaaacagagagagaggaagagagtgagagagagaccccctaggtattaccccaaacaaaatcgtgggaataaaagagaaaagtgattggcaagagcgcggaaggcgcctgggggaggggagagggctggggactagcgagggtgccgggggggggtgggggagctgacggaggataactgagtttaaaaagaaagaaaccaacccccgaaaacaaacaagcgaacgagcgccagcccagactcggaaaggaaacttctcgctcccctcgctctcagcccgatcacccggcgcggggccgcgtagacgctcccgaggcaggcgctgggacgcagcgcccacccggcctcccggcctccgcagccccagcccgcgcctcgcggggaccgcccgggcccacttggagcaactttcctctagagaagacaattgtgcgcgcccccggcctgccccagagctgcgcggcgcggggagggggcggctgggggcgcagtgtgaggtgctggaaggagcaaaacacaaagacgagagaattttgattagagacaaatgatgcttttctctctctctctctctctctctaggttttgtgtgtgtgtacgcgtgtgtgtgcgtgtgtgtgtcttttgcttgttgtggtggaggtgtcgagccatatgggggagtgatagaggaattttagtcagaaactgttcgttacgttatcctgcctttcccctttgtgctgtctttgatctatttgcttggcttagtattacagaaaaacaagtacaataatatattccgagctgcttccccaagattcagttcaggctgcttctttttaagtctctccctctctctttctccctctctctctctcttaatttaatttttttttcactctggtgtctggcattatttaaggtggtccttacacaggagacctccccttccccatctctgagtaatttagtagacactaaaattacacctaatgtccccctctcctctcttgtgtttcctctgttccttttattaaatgttggttattgattttctaaaatcaatgtctgttgtggggcttttttccccctcttacaagtatctaaagcacgttgctgatcaactggataacaaaagctttgtgtcaaggaggcttttttccctcttctgttaaacagtcattttttttttttgagagaaaaagagaatgagatttaaaacaaggctcccagaagtgttcttttgcagggaagactatttaaagtgtgcatttcttcttgccttcctccttccacctccttcgggattttgccaccgttgaccagcctggccctagcagtgaggtcaggccagagcccaggtctaaggaaatagagggatcctggcttcctgggaacccctaggagacctggcagagagggaggcccgttgggcgcttcgcaggtggaatggagtgccagagatgtccgcagtcatggacactgcaagtatttcccctccacccagccactaacttgggagaagcctccacattcagaagtggaaagttgaattgcacattttaaggcatttagcccagatcctgcacacttaatatcaagcctgtccattgcttacagcttctctaactttgactgttacctgtctttttttccaaataagctgtgggaaaacatgctgtatactggttattgtaagtgtttttcactgggtttaatctgaccgagcaatgttctggttttgagaagcaggtagaagagtactaccaccccacccctttttcattttctttctcatcaaacacatatccaatgcctttccctttgggaattgctaggatttatctgaactgagtggatttttcttctttcctggattcatggaaaagatgtcacttttgagcttgtgtctttgctgataacactaaatatgatgatgcttatcaaaatcatatagaaattcctggaaagaaataatggcaataataatcgtataagtagaagctggaagggaaaaaaagatggtcatccaggaacctagaatggcactttatataattttaatgaagtcaacagtgtatatatagactaaggcgacaaggagataaaacgtgtaaagcagtgtgtgtgttttaaaggctggtcaagaacgtgagttagaagacaatgctatgtacatttaataaaaagcaaaggagaaggaggcagttgaagaaaaataaatgtacaaagagagaaacaagtatctgaaatacaaccttccagattctcaggctagcaagatgcctggcagaggcagtgccagggccaagttaacccatagcgggcagtcagtctcctttcccccacatggaaaggatgaaatctcttcccagaaaataagatgtgcaggaggaaagagggagtggggtgagggggaaggaggcaaaaagcgagttgcccgcagacaagaatgtgtgtcggtttcaagaaagttcagtcagatgatcctcagtcgcctgactcactttgtaacactttcactgacgctggagaggagggggaaaacccagcccccctttttctttcccctgattataccccactatctccacacagccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaaggtgttctgtagtgtttttatgctgtgtatgtgcatgtgtgtgttttgtcttgtgtttcctctgaggaggtaagaagaaaagccatccatgcgtgtatcttttggcttttctcttctttccgttctctcctacatattatgcatatatgtagcccacatgaatacacctgtttaaaagaaaatcacagttcagatggtgccttgctggttcatttaggaaacaacagttattagaagttggtctgatttcgcgtgtggtccatgaagacagaaaataccaactcttgtgtcatctggtgggaggcaaatgggggaaaaacttttataattttgtagtaaattagagaggggaaaaaaactgccagtctgtgaaaagatttttgcctctccgggaagacacacacacacccagtagctgcaccgttagctgaacccctgacacggcggtcttttgaatgccttaggtatgatttcactttcgctcacatcaatgctgacctgaatgcctttcatatctgatccgctgtgtctctcccagtaaacatcccctgaggggagaacaaagaaaggagctcttcttcttcttaatcacaattcagccctttcaccgccggcaggctccatttgcattctgccacagaaagccaagatgaaaagaaagagagagagaaagagagagagagagagagagagagagagaggcacagggtagtagctgagtaaaataacttaggtgtttgtggctgtttgttgggcttcccctagttaccagccttatatagctgatgctccaccaggccctgtccctcctgacaggcatatagtgttacaagatggcatgtctgtactattcatggccacccgctcaacacttgaggtaaaaagtgtcaggaggggatcgaattctcccccagaagcctgttagatttggggtcaggtgtgtggacttcccgcccttaagtgctgcctacgatttggctttaataagtctgattgtttaccagcggaccagagaggtgagggccctgggggtgggagggacgggcgagctggagactgggcccctggtctggtttcagtgacgggtcctcacacccagcctgaacacactgataaatcctcaggaaaactggaaaagactttcccatttttccccctgactttttatgataattcatattttcaaatgaaaggggaaaaaagccaagaagaaactctcaaatgagccaaaaaggaaaaaaaaaattctctgaaaagaattttagggggaaaagttgtgctattttaaaaagctttgagggctgtaaagtgccacgtttttcacaccttctccatacttttttttcagatttttttagtatgtttaacatttgtgagatgacagcctttttgtatctcaaactggatgcttcaggatttgtaggggaggggttggtggtattcacgttctcttgtgagagaaagtttgtgcctaaaggcctccttcctgggaactgtttaaaccctcgcaggcagacctgtcaggttttactgtgttatttgccaccattttcaacatgcaaaagtaacatgcagttaatggtattggaatgagaccacagcaagagcagaaacctctcgtgacaacttttcagcgacattatcttgctcctagactgtcttgtctttttcttcccctttctgaaaccacttttgagataccaataattttctcccaacaattagattaaggatacaatgcgctcacacacatgcaccacacacacacacattcacacacacaaacacacacacaaactttggaagtgcaatctcttccaacagcagagtgaatgatttgaaacgggggcttttccaataacccttgtggaagatttcacttataagagcaaaactaacggatatattagaagttgtgcgaacatgtgacacagattcctgatttttttttctttttcccagaagatttacagaatttacaaaaagagattatccctacaccttccacccctcctatccacccccatgacccaagcaatgaaggatttaggcagatttacttcagtaaacacctttggacacttgcggggaaagtgggagtctgtttgcaaaaggaggcttttgttaagtgaggtacggggataatgctttaccaggcagctgtgatattaacctacccagcaatgcgggaacactctttaactctttgagtgcctggccccttgcgctcagcagataaaatcctggctctccaaagacactcagaattctggctctagcagtttattattcagacaagtcttataggcatgaaaactgttcaagcttttaaaacaatgtggtttaattagatgaggtggacttacattgctcataagccctccaaatggtggtttataattggcaagggaaaaaaaaaagatagaaaaaaggaatcaaggcagcacattaaaaattccaggaaatatctttagaaaagctattttcatttctagcttttaaaatattagactacggtagctagagggaatgaagcagctggggcctctctccttcctataaaagacaccagaagtttgtgatgaagaaaggggcttcaacttgaaaagctatgagaggccagttcggacagtgatatgatctcagccttcgcatcttttcaagggggaagtactgcctatctgtccaaacctgggaggtcatgtgaacctcagagtcagggcctcaggctggccgttaccaacttgagactttccaaagcaagcagagaggcatttatgaggaaggagttaatggttattttttgctgggcacaagaataactttacaggtgttgcatttgggcttaaataagattgccttatttagtttcgaaaaagagtgtaggtgtcaacattcgagcagccacaaatgtgtgagaaagtaaagggtatgagacatgacggaattaaaggtgtttgctatgttgttacaccgtgtgtcaggctgcaagctccctttgtcacagcctcctggtgatttgacagcgcagatctacttcccttctaggtgagacagcatttttaaacttgagttataaatatggtacacccttcgagttgcaccctgcctcccagatccgtgaatcctatttgaaagcatcttgccctgagacacaatgaacaaacgcccgtatacaaggaggctgtgggctcgggggcccgggcagcgccagcatcacagtagctggcattgactgttgtttggcaagaaggtcctctgccaaatcatccaataattaagttttatgttatttgtatgaacgaccaagcatgcagtattccttttcaaatcaaagggaggcttaaaattactttttgaacactttcagaccatggtcaggtcacagtttgggggctgaattaaaatgatctcattcatgatctaattgaggttggcaaaaccttagcagtagcaggagtacataaatataaatcaaagaccaaaatttagcaaatcatatcatttgctagaaatctgctcatgaattattctccgattgccaacccagaagttaaactttgtctcccctcagcaacagtaactgcgcatattttttcaggcttctgacaggaaagttagaggatctgaaaagagaaaggagaaggaagatgatcactgtgtcatcagatatggtacatttgtgacccaagaaactatgagagctgataaagccatgtacgtttacagtggctgctgcagccttggttagaaattaatatgggtttctaaaaaccagactttggaagagcaggcagcacagacacattaagagtgtaaggggagcaaacgtttcaagaagggtctgattgtactttgctttcattttttcaattgaggaatgtaatcatcataatgattcatgattatttacaaatttagttctatcactgagctgggtccagggattgagatttgaagtagtggttagaactagaagacgatacggagctgttagtgtgcatattcaggttacctttcattctttctttctttttaacgctgctataaaattaagactccaaataacttttcctataatctgtgggattaaatgtcatactctattgtatctaatccatttttaagttgtaaatttttcttgtttgctgtgtatgatttcatcttaaacccacacaacactttactataaactagaagaggtctaattctacagttgaatcttttgaagttaaaattttaaatcctgtgtaaaagaagatgttcttttaatcaaacagtaaacacagaactggtcagttggccacctttatatatcacaaatatatgaaggtatacttttaaatcttcaggataaactaaggtgggaacatttaaaaataatctcaggtgagagaggtagatgaccacattcctgggaataggtaactgtcattaatgatttcctaaaatgtattctacattaaaaaaactgtaatggatttctctttaatagttacgttgcccatagacaacatagtgatttttgttctttatatactgtttcttatttttttataataactcaaggaaaggtactcctgacaagatgatagccaccccctcctcccaaatatgaaataatcagtaatagatgaacagattaaaatattgtgctatataaaatctgaggtttttttctttctctcaaatggatgagtaaatttcaaggaattcagtgcccaagtgatctataaatgtaatatattgctttcaatgtttcttagtttaagaaagtatttattgtcttgtatatccaagtaactgtaatcaaggaaattgcaattgcctattcttggaagtacctaagtttctattttagacaccatgcacatcaatggaagtgtttcacatcatgagaattctcagttttaagaggtgaggtttatatataaggaactcagtaagctgtgttttcataataaatagacccattaagagggaaatatctctgagcaaaatggttgtcctctaaagatttcccatcacctttgctctgctgatgggaatttgaaaactaaatacagcccatgtgcacacattcccacatgcacacaaacacaaatgcaccctaggatccaaactctgagaattttcctctttaactttcactacagtcatctagcttgtgaatgaaatacacttaaacaaaaatagtagaggcgaagaattaatgtagattcttgtttagtaggatttattgtaggggggaaatgtgttccctatgccacatgattcttacgaaacttacacctattaatctaagctttaagtgtattatttaggataaattactagctttctgcttttgtactgttttctcccattttccttcagtattaccaatcttaacacagattatcctaaactgattgcaaattattatggtttttaaaacagcattctggagtcctgaataaagatggtattttaaactagtgtttacaatatacagaataaaaaagggtgggggagatttaaaaccataccgaacacttagaaatgtgtggagttttatacttgtgcagataagtgtgaggtagccttgccctgtgaaaccaagaccacaaatgatacgtgtcagtaggttctttgatagggcttctggccacagtgtttttgtgctgtcaaactgctatgttgaacaaacacctcctctgggacagagtgataaatgcagagacaggctggcttcaaccagtctcagcaacctcctcaaccacaccccccactcccagcccacctcctacctcctacaatccagccacctcccactccactttgcccctttacctgaaattgacatttatatagaggtgcccaggattttttaaggtgtcagtggtgagtaattgttgatactccccaaatcttatgaatcagtactctgaaactgcaggcaaagtcctttttctggcaggctttatctagtctttttaaatggaactggactgagcttctaaacttttgccaacttgaactttttccacctttgcttaatcacttgaaaaccacttgctttccttgtctttcccccagtcgctttttattttctaatgttcaagctattacattgtgcaacacagacaaaattttgccttaaaaaatccaaacactattacctcttacttttcactttctagcattcttttagggctaacatttcaaatgtatagtcaactggtctttttttttttttcttctctctcttggagccattattctctgactaaaacctgtttactggtgcctttgtgtgtgcgttttttccccctgacattaaatgaatttccatcttctacttctgcaatctctaagaaatagataaaccattatattttttccctgctcgtattttaaagtggtgatcctgacagcaggacgattattgcactttatgttttagtggatgtttgctgttgctagttacagcaacacttatcataagacagcaagaaaagagtagtccctggtaattaaagtaatgaaatattcatttactctaccttttctgtagtctcacaaattaggctgctacatttaatgcctgcactgcctctgtttttattataatggcagctttcgcatctgcaattaggactaattctgacagttacaatttctgagggatggtaaacagtgaacgagatgtgcagcagaggtattacacgtgaaaagcccttgtctctttaaccttgttgttttttttctcgcagaggttaccttttcccgatggtgcaaaatcgacttgacataactgttcatcagtttcagggttttccctggaggtatttgcatcaaatcagcccagtcaagcttcaagttgaaattggcaggccagaaactcacagggtagagactggaaaagagacagccaaagtacaggcagcaaactgacagcagcagagtgaaagacagaggggtggggggaggttgagagcgagagcttttcaactttagtgtgcgggaaatctcagctcctcctgtactgatctcagcagcaccatatcctgaaggagcttgaaaggttgagattcagaacaccttcagctaattcttaccactagggctcaccagccttgctccgggggtttgctctcacttaatctgattggatgcctaaagaggagtgggcacacttaattaaacggaaggaaagttctgaggcacctccccagcacttattaaagcttgaaagccaaatctcatgatcagtgttataggaggaaattaaggtggtttgttttttttgttgtttttttttttttttctaattgttaacttgtaggaaagtgaacaatccctctctttaccaggtttgttttcttgggggttctcttctgagtagattaaatgttcacagagactagagctcaggggactgtccattcaaaagctaatgcattttggctaacaaaaagccagtacaagtagcaaaaattatatttgaagagatactcctttgaatgacatgggtttgcaagttctctgtcaaataatgccctactatcctggtaatatgagaacacgtattaagttgtttaaaaggtcaaaaaacatggcaaaaccttaagatgtctaagatactcaacttttactctcaacaaggtcactttaagaaaaattctatgattgcaaaacttgtataattgcttttacaaagaaaacaaatatgaaaagtgtttcctttgcctgagaacattttttctccttgatgtcttaaaaaaaaaaattgtcatccttccccgtctcttctaactttggagtgggagggggctggtgtttttactagatgatttaaaatcctccttactttccaactagacttgggggtcgaataagcccttgctttcaaaccgttttctagctctgtgtatgacaggcattggctgatctgctgatgcccattcgacaggcactgttgaactaaagtggtgtgacggcacagttttgttaagctgtgaacaaagggctgaagatgccttgctggcatcatccatgtgcatattggccttgtcacagttttgcttgatttaatgctctgtttattcctagatattaaaacttaaattctgaacaatatgttttcaaatactacataccaactttattttaaaagctttaactttgaggaccctagggtccatttgctcatccagtttctgtgtagccaacattaaaacacagctttggaaataaatagattgccagtagcctcttagctgttatccatttaaaaatgggattccagtctttaaaagtcttattaggataaaagatttatttttctttgatcattggttgaaagtcattatttatttccaacactggattgtcacataaattcctaaggaagagttaccttgtgtgtactcagtgcagtcagagtagactttttaaaatgacaaattattaaagagatattcagtaataaaagaaagcctataagaatacctataagggtaggcacatcaccactgagagaaaaaaaaaaatcaagggagtttatgttaaagtgagccctatttaagagatagcagaagaattaagattgagacttaaaaacaaaataattgttatgaaaatccctgttccagaggcaacagctcgcctatctaaagaaatcttaagtttggtactaaatttagattccagcgtcccgttgaatgtgtcttgagctttatctacgctgggtttttgttccccctctgcctctctttccactcttcaggttttcttcaagtgtttgctaagagattagttagcaagtttatattgaggaggtagccatgggaggcagctctctgcttgaaggaacgcgcagtgggtcagagtgagaagatacagggagctaagactgactaaggcctgggatcaggtactttattttctctcaaagacaaaccgcccatagaaaggttggtgggatggcatctgccagcaggagcacagatgttaccacttttagaaacttccaaacaagcattattgctggaataactttatgaaaaaaaaaatctgctgccagaatactcctttttcattatgtaaagaggctataatttgagatattcaaggttatttttacctccattcataaaacagcatctttcttgagagctgttacgagttaggtgaggaaggtggcaaaggagagaaaaatactcagcagcctaaaagtattgctgctgctaataaccggtgagactgcactaagaatctgaaatggaatctccggggtaaaacacatccacatttctacctgccctaagcgtgctttcttagcagtgactgagatgaattgtccatttcttttcagtggtagtttttctccatgttcacttatgccaaataattcccacagccagaaagagtgatacaggtcggggtggctaggaaagaataagcctttattgctagtttttgtataacatcaggcatgagaaagacacttgctaacagcatagattgcaagacactctgtggcctgttctcttagtttcatgagaaaattttgtccaatcccataggtgtgaacaagatttagacatgtaatctccaacctggaaaagaagagagcttttaatatattaatagggcagattcttacttaatatataaagtgaattttggcatcagtttggggtttcctattaatactttgttagcaactgtttatggaagagacaaacagcagttcatccaaatagtcctccttccccaacccccaacccctatcttggtattaactgctttgtcctgtcagcttataacattctatctttaaattactctaaatgaagtcataattctagttatgttttgtaacaagtccatggctaggaccaacatgacttctcaccttttaatgaactgttctactttaggatcttctaaggaatagagtgtaaaaagaagcaaagcaggagatgaagaggtctcgtaaatagtttcctttgaacatccacaattgcttacatggccttttccccttttttccaggctggcagaaatggcctagcccaggactcattcaagtgagcacatttcagaatgactcattggatgattggagggagacacaagccctacgataccaatgcagtgtattaatggagaaagttcctgagattgggagtgggtgtgacattaggctagggtattcctgaagggctctaattcatgtgagaatattaagtgtagatcttctagctatcagttagcgtaaggtttcataaacaggtaatgatggctctttccccccgctacccccccatccaatttctagctgagtgaggaacaggctctgcttcatataaatacgatctttgaatttatctgcaatgaggtacagctttaatgatctgtatctgcaagccaggagcatgaatgtgatcttattgtatcatagtgtagagatgagataggctagcgctacagcacaccagtgcattgtgcctgggtgtcgggagcaatccttccatttccaaagcagcaactctttatttttcatcattgtttctttacctcacttgtatgctccttgtgatacagatctgagtgagttgtgcaagcttcagacttgccagcccccagctcccaggcctagtacagagtaattcataaacttaccatattagactatcagattgaaaccaagggtttctactgtggtggaattggaaagcccattgttttgattatcatttcatcagccccaactgatactagtatgctcaaggaaaacatacttcagttacagttgattttcagattccaaaatggtgctgcaaagcctgtgcatctctaattatattttatgctaggctgtgcaataccaaaatatacgccgcagcaatcagtgagtgaacagtatcaatcaatttgtaaacagatgaagtcactcattcccaaactggttttccaaaaacaattactaaattacaatagaaaaaaattgtacagttactgtatttgtgtgctgtgttacaatcaacataccagggaaacaaaacaatttaatgcagaaaaatcatcattcatctacattataattgcttctttttcacatctacagggcggttaattaaaattgtgattaaatgcggtcgcgctgcctaagatgtcttgcccaaaacaggtggtacagaatttaaaagtaaaaaaaatgtaattagcattggaaattgagaaattgcctgtaagaatcagtgttaatttcagtcagtgatgaggtaatttataaatgaatgcagtggaggctgtgcaaatgcacaattgccttccttgccattcttagcattctcagcatgcaggtgaaaatgttttcaaaatattgaggtaatttgaaaatcaatccatgcattctgtatcttttttctcccatttgtaccaaatgctgaacaaatgctgccatagatggcacaatccatcagttttttactttctaaaagtaatgctgcacatattttagacctagattaagaaatataacaacacaaattgcaagcctaaaattgttacacgggtcaaaattgtacacctgaacttctgactaatggagatttggttggctgtgaaatgctcccatcaataaaatagagacatggggggaaatctgtccatggtgtaggtggtacaaacagaatgactattaaccaatccaataaatacttgagattaaatttttaaagtttaagaaagaaacagaaaatttataataaggctgatatttttcttagaatcttgaaccgtaactttgttattccatctagaaacatctaaaaccagttaataaagttatcactagaaaaagcgtttacagaaattaactgtttttcaatgtcatctttcctttcaacaaagatgcaactttctacaaaacattatgctatcaacttactatatttcaagcgttctattggcaaatgagtggattctatagattagatactggttaaaaattatttctatttacgctgtatttttactattaaaccgctagacttttaaaatcttttaatggaagaaatttaactttcatgtgcttattctgaccctctgaacaatatgaatttaaaatattttaataatgaattgagaatatggggtttgagtatctggcttgataccactggagttaagagactttgtggggctttttaagcatcctcttctgtgtttggcattctgcaaaatgatctctccatataaagctcatcctaagaatatgcttatttaattgtggcagatcaatctgatgatcaaattctctcatgtaaaatattctacgtgttttttgctgtttcaggcagaaatcaataatttcacttcactctgaagttatgttttgtggtaatacggacattttcgggagaaaggtgaaaaataagaaatactgtatctctgggagtgtcatctttattcattcattcattcatttttagagacagggtctcactctgtggttcagactagagtgcagtggcaccatcctagctcacagcagctgagattcctgggctcaagggatctctgggagtatctttctatcctctgatttcaggcctagtttcgggccttccctcatgacccttcctgatcatttttaggacacaaatgaaaagtgcaatttagaggtgacagctcagctggttgttccaagtggcatgccatcgtttctctcatatttaaatctgtttcccatttaatattacaagtagaaataaaatgagacctctaaatggaggaaactgaaaggtcaccagttaactccatgatccctctcctttcaccagctcttgcctcccactaactgtgatgatgacgatttcatattccagcagtcagttcactttcagcgagggtgggtgcagacttcatcaaagaatggcttcctggatttccttcaggacctgtgaacataagatccgcaaccacatggggcttggctcaaatttcagcagagtggtgggatggaggaggtattatgacgtgctccaggctgcactggttctgagtttacaaggggtcacaagggttagagaatcacagatgtcaatagagcgcgaggaccttcctaccccttgaaatatttgcagtagaaatcttacctctttacgtttggttcgtagtgccctatgagcttagcagggcaatgtggagttacttgtgagatgccaccaatgtttcatatatatatatagtatattatataatatataatattaatatatattatataatatataatattaatatatattatataatatataatattaatatatattatataatatataatattaatatatattatataatatataatattaatatattatataatatataatattaatatattatataatatataatattaatatatattatataatatataatattaatatatattatataatatataatatatatgttgagaatgacatatatatatatgttgagaatgacatatatatatatatgttgagaatgacatatatatatatatgttgagaatgacagtgtctttttatacaagctccctccaccaagtatcatctctgtactcttacagggtcatcaagattgtcagaaaaggcctggactacatgcctgtcccagcactagattggtattttttaagtccttttttgtttcaaagtttgccatgtgagcttaactcagttcattctgctattattacaagcatcacctctttgaagctgttatcagattcatgaaagaaaaatgcgcattttctttttctactgagggcttctttcacctttattcctgagagtgatcagagctttgaattgtaaaaaaagaaaaattttctcattgtacaataattgaaaagtatgtcatcaggtcctttctaggtcttcctgtggtatgtcagcagaaaactacagtgtttgttcattttgcattaattacacacctactatgtgcaggctctggctgaggtctgtggatcaaaaaatggatgctagagcctgggcccctgaggagcttgctgtctagtgggaaatgggggtgcatttaagatatgatgaaaatgtggcaagtgccacaaagaactttctacccaatacagagagagtacagaggatggcacaactagatctgggagaaggtggtgaggggtcacttcatggcagaggtgacttttgaggagactgttgtcatataacatggatttcaccagcaagtgagggcacagcacgctgggctgagaggatggcatgtacaagccaggagaaagggtgaacagcgcaggcattgtcagccaactgagatgtctgaaacacagggcatgagcaaagaggatgggcttgatttgagtctgcaaaggtggtcagggagcagaagaatgtcctatcccatatttttggcttgtatccagtaaataggtgatggtgagcttgcgaaccatgttttatagaagagtgacataattatatttgcgtttcagtgacacgtctctggcaactgtacgaaagatattatcatctaacatttgttgagtacttaacaatgtgctgggacccgtgctaagaattttgcctatgtcatctgatctcgccccaacaataatgctgtgaaatgggtactattattttcatactatttttactgatgaggaaattaaggtttagaaagggcatgagcctggagtcaggaagaaagtctacggttacatgttactgtaatcatggaatttctagaattacaagcaacacaggcaataatgatcattgactagaaggacatttggaaaagaaaacccagcgtttgaaaaagagtgaggcagtttgattctgtttctctgagtgaatagtgagactaagtggggtgtaaggatgtttcatcctcaaaatttattttttctttcattactatgtcagtttgaaaaagaaaataaaaaatggttgttgatcctgaagaaactaatcctagaatgtgctacatctttgagagtttggaaagagacagttaacatacaacccttcaaaacagtggaatttggtaaaccctggaacactgttcttgctgatctaattcatgacattaaggccttcctcggccttatgaggaagcagatgaaaataatccttttgcgatgactattttcccccttttctgatttaactcttccattgcctaagactcaccaattctcaaacttctaaattctccacactgccttatctctgccatcccatggcaagtcctaaagctgctaacattttgtaacaactatgtgacaaattgttgtgcttttattcaggtcggacatctttgccaggcttgcttgttgtgttttctgtttggctgtgtcatgggaccaaaggtgcctgcctttgtacagcatgtcaaatctggttaacatgcagccatttatctttaaaaccactcctgcacaatggcagaggtgggccaagccacagggctctaagcacaacccaatttttcagaccatcttttctgcatatagggagcacgttggacagcagacaagacattttgtgatttggggaatctcttagagacaaattgtagagtgcaagtgcagtgtaactggactgctgggtgcccagtgaagtgaggaaaatcagatacagcacaggctgaaagaatgaagcaagaattcatatctctgtgcagaacatgcacagtactttgctcacacagagagttcacacatagacaaaagcatgtttgcttgtgggttattttcaggggattctatagccacagtctaggcgtatatatttgcacgtaagctttctttctgcattttgtactggtaggtgtgtctacatgtgaacatgtaaacatgcttatatgagaagacaatttgctgttgctgatttaagacacgggaaaggcctcctagttcactgaggcgtttccctcctaatgtagtagaagcagaatctttttgttttctacaattgttttaataaaggactctgtgtgtgtttaaggaagactcagagccagagtgtcaagtgctgcagtgaaaaatactgaagatttttctttccataagacagctgcaaactttataacccagttcactctgggttttcatttctcaattgtttcaaggtgtcttgggaatgatttgcccttaaataactagttatcaacaaaggagaaaaaatagcaataaaaaatgtgataaacctgcatagactagtttaactaaaatgaagaatttccttgcttggagcagttcaaggaccgaacatagcaaaactgtgtgatttaaatgaaatattcagagtggtcaacataaatacacatgtagacaagagatagtatatgtgtgtgtgtatacactgaggttacttcttgaagaaataggcattttttcctttctttttgctttttctttcttttctttttctgagtaaaggaccccagagattgtctttcactttgaaaacaatctctaatatcaggaaaatgcgctgtttgtttatgcgtacataatgcaagtttgtccgcctgggaactgcagcaaatgggagaagtatgcatggatttcacaggtaacaggattacgtgggcacataattgatccatttggagaaaaaaaatgacagtgctctaaagatgcctaggctttggagatggagtttatgaaacaggcatttgtaaattcaaaggaatcaatatgtcaattttattacatctcagaaccagctgggcattaaaggaacagtagccttaaaaaaaattacagctgcatattcctacgttgtctacctttcttaaaggccctagaatttaaggaaatgaacttagagatgtgtaccttttcagaaatgaatttacattgtccaaagagaacaacaatttaacattatgtcagttatcaacctaaaaatttgattgaaatgtctgccttatcattacaattgaagtctattaatagatacagataataagcagaatagtgattttcacataggttgcactgtcaaggattcattggaattcatatttgcattgtgcttttcaacagtctagattttacctcttcactgatgataggacatagtttaagagctagcctttgggtgtcccacagaattgggtctgtgcatgtgtgaaatattcctgttttattagagtttttgacaatctatttttttttttttttttttttttttgagacggagtctcgctctgtcgcccaggctggagtggagtggcgcgatctcggctcactgcaagctccgcctcccgggttcaggccattctcctgcctcagcctcccgagtagctgggactacaggtgcctgcaaccacgcccggctaattttttgtatttttagtagagacagggtttcactgtgttagccaggacggtctcgatctcctgacctcgtgatccgcccgcctcggcctcccaaagtgctgggattacaggcgtgagccactgcgcctggccgtttttgacaatctaaaaagaccaagctattttaaattattaagttcctaaataataggatttggacagcagccataagagaggtgaatgggatgggaatttaagatactattttaatatcacaaagaggttacacaactaaggatgaaagttagaagctatgaattggtccacatactctgcatgtgctgtctgctagaggctgcaaggcgagctgcttcactgtttcatgttccaatctccaccacccagactcctgctccaataacatctctagatctattcacttgtaacaaatggagcccagttctcctccctccccaaggaggccagacactcgatataatgaaaagaacacaggattcagacccaaacaaatttgtgtccacattctgattctgccatttactctccatgccatgtgcccctgggtgcgtttcttaaccactctgaacttcggttcttaatgcttaaaaatggggagcagtatttgttttatagaatctttgggagtattacacaaaattctaaagacagtgtctggagcctagaaaacgctcactaaattctgattatgactgtttcaaggtgtgactaatcaggatgccaggaaccctacgatggaggcacttcagtttctgggccttgctgaaacattcttgaaaagaggaaacaataaccgtagcctgagatattcgttccttttttttttactctttggagagtacttaaaaaaagaagaaaaaagaaatagtcatagtgattggcatgctattctacctctacatttccaggaaatatacatggtactttttcttatagaaacagcatctcctccaaaaagaatacattctgagatgacttttgtcacagcacttaaaatatctgattcctatttgtctccccacaaatgtgtaaatggcttgagggcagtcttgcccatctcagctcaggccatgacatacaaaaattgtttcgttaaagcaaaggtataatgaatacagcgggtatattaaagattcagtatacattatcatatgtagaaaaaagctttgggtaactttatgtcagattccctaccaccatattaataactttttgaaattcactttgtgacagctatgttattttgaatacttgagtgggtttgctttttgtttttgtttttgtttttagtttgtatttaaatcaactggctctctgcctttctcaatgacacctttgagacttgggagtcagggaggcagagaggcagtgtgggtgctcggaagagtgtaggctttggacatctgggctcaaatttggtttctactttcatacaagccataagacctgtagcaagttgttcagtctaactgcatctctgcttctcataataatactcatgttatagggcagttgggaagaaatactggtaacaggtaaagtgccaagcacatagtaggtgattaatgttctgtccccttcctccactcttctttgtcacttgagcattcactttgggttggcatttagtgagctccttctgcccgtcaacaagtcaatcaacatttaatacataccatgggtagatatcttacccctgttccaaatttcattatgaaaattgggctattttctactcaaggaaatgagcatgcagaagtaccttctgtacttagaatcacaatcattttagctattttccgcttaatctgacggtttctttgttcccatcatcttttttagtgaagcactttggtgtttctgcaatcctttgctatcattctgtgcttgggtatctcagatctctcttctcccccgatcctttgaagacatcagaaaagaagaagcacaaggtctcttgactatacgtttgccacacaactgtgtggattggttagttaatagagttgattaaaacactttgtttgattctgcttaagcataccagaaatacattcaaaatctacagctacaaaatgtaaagaaggtagtccaaatatagtactacataatgaggctccctgttggtagtatataaagcagtttagagtatagcttcaaattctaatgaagatcattttaaatcttgcactgaattgtgaatttaaaattcccatgttctccataagtatctgaagaggggcatgtaaataccataagtgaattaattactgccttaagttggtaaagcatgtgtgaatccaaactttattcttgaacttgcacttctcttcccaaggttttttgaaccatttcctatatgctgagttctgagtacctatttaactactgaggacatatgaagaaggtagttttctttgcatggattaaatgtttcaatctctgaaaatcaccaccaccacaacaaaaagtctgcccggcaccatctacatgtacatgatgaaattcctaaagcagaaaagatatatttataatctgaaacttataaaaacatgacaaactgttaccttcacttttgtgcccccttttttcattaacagtattaggtcgtttttttttttttttttctcttgagaagaaacgaaagacgaagtggcaagaatatctttcacttttgctcacgttttggtggtgtaatattgggaccactgaagtaattggacaacttttccgagctgactcttctgaagtaaacccaaggcaaagggaaaatggagctgctgctaggctcaactgatggcgcccacatggcgcccaccccagctccttcagagactccatcatttccacagaagggccagaggccctgccaatatccgcacatcactggcatgatagaccataacagcttcttctgagctgttccggtctatcgtgtcaatgcgtactcggggagtcctcaacgcacggatcactgacacggcactacataacggctccttagcagccattattgggtatcaagtcaatgcctactcagggaggctttatcgcagaggcctgcacgagcagacacattccgaatactaaaattccttaggaaaattagtcattgcccatgtgtgatagctgttttccattttgaattttaaccattttgggaaaaggaagagaatgggaaataccagtatagtccgaaaagcccttaaaaaatgagtgcgaaaagtggaagggtggagtggacataggaagatgatgaacttgtcattttttcctttccatagcttcattttattgtgtcaaagttgcagaaagcacttcactttcatcgaggctctttttaggcagggtacagccaagaaaacttttttatggctcagatgtaaatcctagaaaacgtagtagaaatgatggcaggatctctaactgtaaaataacagtagtgttagtagtaagtgtcattataataacgttatagaactctgcacatcaaaaataccacattttatcatgatctctgcaagagatttctgttggtagtcattctagacttctaataaataatacgttgagtaggaaaggttctgtgaggatccaaataataatgaaaatgacagtggtgatattaataataatagtacagctcccatttattgtatcattattatgtggcaggcatttgtatacattatctcatttaattttctcagcagatgtgacaaatcaggaaactgtggcttagcaaagttaaataacttgactgatgtcatgcaaccactaagtgacagtggtgggatttgaactatatctggggagagtcatgctcttaccattgcattgcctctaatgatcatcactttcagggaactaggtgtttaattagaatatcccaacccattgtctgcttactgatcaggaaactgaggcagggtaattttagtaattcccccaaataataaagagagtcagaatgaataccagaaagcaacaagaggcaaaaacagcctttctctctgacaacatgttaaccacaaacaagacatgggaatttcagagcctccgtttgtgtttcagaaggaatgtccactgttgccatcagtcctgaaaagatttccttgcaccaaatcaaaatggttcgagtttgctgttgttgatattttttttccttttgtgttctgcttactgactgacatctgctatcatgctaagcaggtgttcctatgtaaacgaacgtgccctgtttgtgtttcgccatcctcgctgctgcgcacccaaatgagcagcgtgattaagaatcctgtaaatttttgaaaggaaacggatggctaccctactagaacataattacaccgttccaacatccgcagctcactgctgcagcagagttggagaacagcagaaattaataatatataatagcatcattctagtaatttataaatgaaataaagtagagaggagattctgctgatatgcattttctccttaattctaaaagacaaagtatagattagaattttagtggggtgaaacctggccagcagtctcccactagttgcctgattcatgataggagtgtttttgcttagggaaaagagctaatatgttttattaggccagaggaaaaaaagaaaaagaaacatgaataaacaaggccctctaaaggcaacactaaataaagggggtctgaaaaaatctctgtggattgtgtgcccactgtatttaaaaagatattattactttaagacttcaacatgtgctgcattttttctttcattgtaataacataccaccataggtcaccccttctgagaaaagagggactgatcagttaaagatgtggcccaacataaactttatgttaaatagcactcgtgtaaattctagagatctgctgaacaacaatacacccatagttagcaataatagagtagatttcatcttgtatgttttatcacaataaaaaagaacattcatgcctttttaaaaacattattttgagtacccagtatgtgcaaaggagcctcttattacaaatcatcgttagattaagggagttgatgcttttagtcaaccatgctggagaaagaacaacactttctaaagaggcaaataaactatatgttaaaagtaaccagtccatttctctgtctcatagggttgtggcaggcactttagaaactttaatgtttttctaacttcatttaccgtaggtaagatgcctaacaaatggatgagctcagttgtttcaagagtttgtctcccatgagccaatgcccatcacacacacacacacacacacacacacacacactcacacacgagcaattatccttaagaaaaataatatttatagcacttaaagtgttatttaagcaacttttcctgcttaattccaaagaatgacaatacatccaaaaaaaaaagtcatggattttcttcctttaattaaacttagagaacatgaaaatactgtttgcctttcaagagaagcatgtccatttaagatgcttattcatttaagcagtattcatttaaaggtccccttgagtattactctatgtgttttgatttggttcagagaaaataaattcatttaatagatttatttcattaacaggtatttatttaagtgggttccactgtatttaaatctccaaacagtttccattacttccttagctcacttgctccatgttgactaattttaataagcctaaggtgcctagggtcttattgagtgttcagtttgatcaatatggttaaattaaaattgtgcaaaatataagcaaatgtactctaacaacacagtgaaaaatgtgctgtgcactaagcattgattggtatgctgtggacacagatatatgaagctgggtgggcctctgaactacctggaaactgccactctcctccaaagctcccctggctttagatacatccatgtgatctcccacccgttcatggagacagcagctcagatacccccattgaattagaaggggaaggagattcatgtcaggtgttttgctttttgatttaatggaaaacagcatgtaaggctcacagtgaaatcctatataaagaaaaaaagctaagattttataaaagttcaactttgagtattgctgaaatgctttaggtaataaagaatgcaggccctagttctttttcacagaataactttttaccgtaattatccttaaattttaatcatttggtagcttgaattctttttcagagatcttacttgtcaagtttgttttagcaaattacaaaaaaacaaaaacaaaagccaacctgatttttaaagtataccaaaatcagctttgccattggtactgcatttgaaaacctagtaagctttctaacaaattcattgctttctatataattgtaaagttaaatagataactgaatatttttagtggattccttttagtatgaataagtttgtatcttctattcctaaatcaatttctttacctttccctttttctcttctttttttctccttttttgcctgttttatggcaagcatacttaatattcagtgtcaatctttttaagcttttcaaaaatctaccacaatcacttaccaatcataagtatatatcattcaaaattgttcctgatatgtgctggctgttggggcagtttctttttcctacctgttgtgtgcctttgtacctatctttaatctcttcttgctaagtgatagctaccatcacaacactggctttccttgatagcatatcttcctgcatgtccaaaacttaagttcacatgagcagaagttgttcttatcaaaggtaaatcagaagttaaaaaaaaaagcagagagataaaaacatcaaaaatgtacatcttgcaagcaatgatgttgaatttgggagaagtgtgttctattgaaatgaaaatcattttctagtttaaactgatcacggaagtttatatgcataataaggatttgaagtttcctatcaaattaagtacagtgtttgagcttcctaacatttaataataccatcaccaatacacctgcaaaataaaataatgtttgagccccaaaatcatcagaaatatgtagaccaataccagttcagaagaattgactttatttttgtaatggggccaagaaaaattcttaggtttttgtttagttttgtgcttgttaatcttgatttttcccagtgttttgcatgttttgagtttttaatatcaaaggtactgctctttgtaaacaagtgtaagtttacccaggcagcttcacttacacccttcccttgtaatcagatgtgaaaattacaccctcccttttggatacatgataattacacatttcaacatgcaaagaattgtctctgtttcagttgttggaatgaaaaagctgagacatttcagtaaaatatattattatattaaagatcatttccataattgttttcgggatttgtaatcaaaaccatgatcaaggtagtcttagttttaaaaagaatacacatggaaataaggagaggataaaattaattgccgagttccacttgaatgaccattcttttattttatgaaaatacagttaagtacattatattctttctttaaaaaaaaaaaaaaccttctagtaccttatttgacattttctttctccatgttcgttgaattacctattttttcaggtcgaccaaaaaaatgtagaaatacacatttttgtgatcaaggtgaaaaatttagtcagaagagagatataaatacaatgaaggaatcttttcaagaaaagatgtgtttgtttttgtttgcaagagtgcttttcagccaaatataaaattttgtaaactcaggtaaggcacctcacacttcacaatcagacttctggattcatctagagtatcactcatatcataggtaaaaatatatgtcactattggtataaaatacactgaagccttaaaaatgcagaggttttggcaaataacactaactcaaaaatatcttgtatatccaaggagagggtttaaaatcaccgattcctttttactttcttaagctaagaagaaaaggaagagagaggccaggcgcagtggctcacacctgtaatcccagcactttgggaggccgagacaggtggattgcctgaggtcaggagttggagactagtctggccaacatggtgaaaccccgtatctactaaaaatacaaaaattagccgggcgtggtggcgagtgcctgtaatcctagctacttgggaggctgaggcaggagaacagcttgaacccagaggcgaaggttgcagtgagccgagatcatgccgttgcaccccagctcaggtgacagcgtgagactctgatgcaaaaataaataaagaaataaaagaaaaggaagagagaaggcagcattagatggctgatgttatggcttcgtgaaacagtttatggcataaagaaataactccccaactccttagttttccaagtatgtaaatgtttctgctcatccaaacactagcataggtaagtgaggacacatatttcatctagcccaaatatattttttaaaagaatccctgcagattttttgcttctataaaaaatatcccaacccaaatttctaaaaattttgatttttggaattaaatgataatactaattagcatttacctatacatccttttctattttaaaatcattgcataatctggcatttatatttaattttctaaatcattttccctagagagcattcatgtaattttagaacttggaaggaaccaggatttcaactatactcatccacagacttttcccattgggtagaaattgaaacagaactgacagaaccaggatttgaataccagccttttgactccaaatcagggacaagatgcagttttgtatgttaattatttttattggttttgatattgtggccccaagatccatagtcttattttcatgctaagtgactctttactctgaagggccaggttataattgccatgtatgccaagagtgaagggacccaggaccagaaaattcagtatgcccgggtggtgagtttttagacttatggagctgcatgttctgaactccacgttctttggttttactgctcctgtgttttttgacagttgcttttttttttcttcataatttctgtacaggctgggcagagagttcaggaaatgttccaccgtgtactgacattcccctggcaataagtgggttcccacttcagtcgcattccactaagcctattttggcaccatagagagggtgatgagagggaagagtcagtggaggagaagacaggaaggttgccaggaaggaattgaaaggcatatgctcctggccccattgcctgtgtctgccttcaccacctttagcttcacaagcagtggccatggcaaataggaaaaggtttgggtgggagaaatacagaagaagccattcctgattaggccatgtgtcttccactagtttccatcagagtgggctgaccgatctgtgaagatctgggatcatgactcagtataacaagaagagtcctacacatttgattcaggaaatttgggctcctggcccacccagccctgccttccaatctcagcatggccttggacacatccttaacctctctgggcctcacattcctaatgataaaatgcagggactggacagagattgcaaactggtggctgacagatgtttgatttgtcccacacagtattttaaacacatttgaattggttgccaatatttaaaaattgggctatttcacacacacacacacacacacacacacaaatccagatttccagctcccctggagaactcagatgatctggtgtttcgggcccacatagctgcatggaaagaccatgtgggaacaactttgagttccgtaagaaaaatcaatcaacttccctcacctgcttggcctgtgtagacatttgagtgtgggaccccaattctctccaagactcctttgaagctctagttttagaattccaaatatgatttgcttgaccataagaaatatacttaatccatagtggtttctatattcacggcagaatgctaaggtatttgtttatacaatcagcatcaggtaaaagttggaactatcttaggccaaataaatcagccccatttagaacaaatgctgactttgaaatttgataatgggaggcaggaatagttcagcaaagatagcctttgaggtagttacaagaaagatggtttggctcctgactcactattacctacacagcgaactgtgtattttgcaaattatccaaaagtagattctttaaaacccaaatcaaataatacaaggcccttcagttaacattttttcacatctcccactctaaactaacatcttcataaatattgagatcatgaactttttctgttcatgtaattgcaaacaaattatattggcctgggaactgtttgatcttcttcaaaagtaaaggaactacattgattttaaaagttatatttttgtaaatcatgtttccaaatgtatccactttaaacacaaaaggtaacatttgcgactcatggttatagagtgtttaatattgtacaaggtgcattgacaaaaatatctcatttgatctttacaacaattgtaggagctagacagagaagacatttaatacaaatgaggagtctgagacccagaaaagttggatgactattggaaaattgacctattacttgcttaatgtgaaaaagagccgggattcaaatctacagcttttggctccatatttaatgttttccatgccatcagtatgcttccagtgtcttagggtatgtgtgtgtgtgtgtgtgtgtgtgtgtgtgtgtgtgtgtgtgtgtgtcttacctaaacactgactttttctctctctctgtcatgaacaagaattgagaggttaaatgggaattgtctcatgaattgtctcaatgttttctaagttgaatgaagaatcttttttggtagctattcttaagtgaatgctggatttttattaagggaagctaacagatatttaaaagcaccctccatatataaaagcacaatccatggaagcatagtgcaaggaataatgatatagacaaatggaggaggggcaataaaaagtcataaaacaggcaggtagaggtttctggaaaaataaggtggtgagggaagagtctaactgtaaaagtaaaaaggtagaagatagaaccgttgaaaaaaaaaagaaatatcagaaatataaagagaaataaacagcaagaagactccgtagtaatttaagaagtgaaaacttttaggacagaggtaggagagaaatgggaaacactggagaggaagtaacaactaggaagtgtggaagaaaaacctgcaggccagaaatctgagcaaagacttgagagaggatgatggtaaatgtgaaacattgaaagggatgttttaagggattcagacattgagaggaaagtaaattttcatcacaacaccccatgacgacaggctcaacacatttggattatgagaaaggaaattaacatggttagaacgaaagaataaaaattagtaagagaaatctttggatgtcaatggagaggaggagaaatgatattaaaaggaaagaaggcatgggtggaaagtagaatgagatgagaacctatggtaggtggaggtgaaaaatgaaatgcgtcagggaagatcatgactgggaccgccgcacactgcagtgatgaagacggagaagctattcttcagggaacctgcaaataaaaagaaaccttaagatgtatttggagggaacccaccccagcaaggtgagaaagcaagaggttacattctgcaaaaagagaaaatgaacggggagaagggggaaaactaggggaaagagaaaacagcaaatcaaagttatggagcgtacagcattgaaaggaatgaggcattctgttggaattattcatttaagcatatgggtattggcgtcccttttctaaaaccggatcctctcccttatttctcatttttctataacactattataataaattcacatggaaaagtacaaggatgagcaattttttactttagaaatgtttcaaaaggggaggtaaacttgatggttatctgtctgaagggtgacgcactatagtggcatgtgagaatgaggccagaggtaatcatcagttttgaaattgttctttcaacaaattcataatgcatataaagtaactcgtgcacacatttatggcaaaacatactctagatattaatttatattgcttatactgaagatctcttgagttttcaaaaagtttgatttacagatttttcacatcaaaaattttttgtagattctattttgtaattaagatgtgtagactcctcaataattctttaccttgatgctgtgtatactcatttatctagattaaaatacttccttgccctgaatgttctaaaagtgtaccccttggggctctagaatttagaagtctcccttccccaactatttctagtctaccttttcaattgagttaatataatggctttagaaatacaatttccatgttgctataaaaatggggttaaaagtcataacaggcacaagaaacaggaggaaatgagaattgtgtactttcagtcacacccgggccatgtgctcgggccacatacagcatgcagccctccggagtgggctgtgtaacccggggcacacttgaggtcagggcacatagaggattaatttactgaaggtggtagacaatccctctgccacaaatgcaaacattttttcataagcgcctgaagcaattagttctcttcaataataaatttaatcttttcctccttcctttctttcctcttcgtttctcctctttcttctcttttcctctataaatgctggcctttgtctaagatcttcaactcaaaggtgtagatgccaggaaagaaaaacaaaatcaatgtattgtggtactaacaaataatgctataattattagaaaaaaacagattgaagcaagatacaaaaattctcaaaagcagctatctgtatgaaaatcttttctacttctagagagtatgtgaatgactgtatctttcatatcgtgaaagcagatgcttacatgcaatcacctttaaaaaaagaaacaaactatcacagtagtgacattgcctattttatatgagtagggaaactagccaaatagctttgggaacatttattagccttgtccttttttttcttttttttttttttaacttttagtatagagagaaaatagagatgacaggtaggtggctaagtaaggtgacaggatggcagacagcattcctatcagggcagaaagaatttataagggagctgccacttatagcgtaatagagctaagttaagaattgcaaacagagtagggccaagcaacattttaagaacaattgtccttaaacattcttgtaatgctaagtcactcatctttgtttcccacttgcttcctagagttaagaaaagttctttcctaacttgggttgctatgcagagatgtgaaatttcattggctccaaatgcttttctgtctagtagggactactgggaaccctgctaatgtgcatattgatgtaccctgtagcttcacagatgatgaaagagcatattacttatttccacaacaacaaagctaagagaaatttgaaaggagccagttattttacctggggaatttctcccaggtgatggggctatggaaccatggaatttaaatatgggggccgtcctattttctaaaaagtttttatggggagccataatatcactcccaagcagaaatcaaatcaaataaaagactattgctttcatttgcatttatttagtcaactatgcctaaaatacggaaaagatattatcatgctcattcagagtgtattttattcgttgtttactagactggactgacatgatatgatttgtgctttgcggggtcacaacaagctactagcaggacaatttgctgaatcaagaggatgattgtgtctggtgccagtcagtcgcaattaggaccaggatcagggaggcccggggcttgtgcatcgtcttgggcaagctgcatagaaatcagctcacctgaaactaattgtcacaacagagaccttatgcaaatgagccctggggttagcgtgggaaaagaaaaactgtcgcaaagataggtgacctgctgagcagggggtctgttgctggggaaatctttgttcaatgagtttaaaaatgttttcattgttcaaagtccaccccccgcccccccccccaaaaaaaagtagcatacacactcactaagagtatggcaaacacactcatctaaaattccaataaagcagaagcctgctttggagcatgccataaattgggagtctttataagggctacagcaggagaataatttccctttgcaagggcctttaaagtttaggtgctgcggattgcagtgtggcctaccttgaaaattcacttgcaaggtcaagcctattgctagcctggcaggacccgcacagccttttctccctgcattccagcaggccacctccacacagccgtgaggggtgcctgtgaactagacaagaaaggcctagtttctaattgagctttactggtatctcaggtagaagagaagggccaggagcactctcttaacacatggcaaaagaatccggggaaacaatggcagtttcttgaattgtggtttctcaaatactcacaagttcaaatgaaatgcaagcattgtgaaattccaggaatggtaatgcagcccaagtggtaatagatcataaaaatttagcaaaagaaaagtaaaaattatttttaaactatgatttactttgtttttcaatccctgacaaaaacacgtataagttggaaatgacgtttgattttattgtagcactcatttggaataatctttaatatgttttactttagaaaaccagatgaagaaaagttattcaaaggtaatgataaacatttttatacgttactgtagcaaagttgcctttgggttcttcaattgatttttagcttttcaatcttgttttcataaaaacatgggctaacatattgatacttcttagctttacactaaagatttcccagtgacatagtagataatgtatattcacacaggagtataaatataatatcaaggaaatgaaatagagtgttctaagctttagcagtaacagagagcatagatattttgcatctaatgatttcaaagaaagaataatttgaatttaaaaatgtaggtgagagaaaaagaaagtttcattgcattggcgttgaatacaaatgctattttgtttggcaaattactggacctaagaaagtgttttcattgtgtttcctaaagggctggattgaaatttggacttgtacctgataagcaagctcaggaattaacttggtagccaccacaaaacctaaagaaagttaggcttagaagtgcaacttaatcacaatttagattttaacacacacgcatacacacacatatacaactcttttgtcccttcaccactgtctgaaataatttccacataagagacatttcacagtgggtacgaagtgctcagctttcactcatcaaactttaatcggaactgcattttagtttttgaataaagaacacttaaaaaatttagatgcaaattattttgcattattcatgctctaagtgtccttgtagatttaaacacttctgaggccaccttgattcaagtaattacctaggccctcactgctccgtcatgaataaggtattttgtacaagtaaagtatgcacccgatgagcttttaaagtggctttacactgaacttgtgtattgcttcttgtgcatgagtgagccgaacatgtgtcgcaatctgtctcaggtgggaaaccctggctgggcatccatgggtgacgggatgaaacccgagcgtctccttcacacacatgctcttcctttgtctctacctaagaatgttcctgcctgattctagtagttgttttaagcattaaaaaaaagcaatagattctaggaaaagagacagggaaagtgacagtgattccgcttaaccccttcatcaccagagattattggaaatgcccacttttcaggcctcctcatctccatcagcaaaggcttccttgtaaggtaataagtctctctcattttacatggttctgtacatctgtctccccatctgtcagcccagcatcctgagctattagagctaggtgctacctccaccacggtattcacacgaaatggagcaggcttcaaactcaaaagtagctgaagaatacttacaatggaaatgaaagtgaccatagagcatcaatctgtaagtttatccacacacacaaaaagagggtttgtaagagttaaatgtaactggctgaagcttatagctggtgtttgttacaaagtacccaagcttttcctttccaacttcgtggctttgaagaattataggaattttatgatgtgctgttggagttatactggcagagattacagtaaaggggttaaagttggtttatggtagaaaaaaaattatgcagaaaccaataaaaataaacacactcaagtagactaaacttgctgggcttttagttttacttttaacaaaggaagtttagatgaaagtaaatgttgcagcttttagaaaattagttgacactcatacttgatcatctttactatacagtggtataattaatatttaaacattctaataatgcagcttgctttgcatgcacttttcagcctcacaacattatattttatctggaattgtgctagcattttcttgggtagtgcccattttcatagagttaaatttaaaatagggtagggcctcagctcttattgccagtaaaacatcaataggagagtgaacaggtttcatacatctaccagacagtttattattaagaacaatatttatttgagataatagataatatataaattttgtttcattgccccatgaatgtttttaaatgatcagaatagattaagtttgaaagttgcatttggctgttgtccactcactgttcaaaacaggaggattttgatgatgtcaaggcagtgcgaaatcagcaagtgatacatgaaacatggaacccccatgcctgcccattcattagggcatctgattaacatagtaaggaatgtttattttcagtacataaaattgtagaactttgggagcatcttctgaattgcaaaagctgaacacccaggaacttagtgaaacaataaaaatatagagaagtaagctaatttgtgagaagcctgagctagtttattttcctatgagaagtttcttcctgttccaatctcatggctgtaggtggtagggaaaagttgtttcaggtgctgccctcagctagtccctttgaagagtgcaaggtgcccagtgttcctgatcttctagtttgaatgatgagaaagagcattctacctttccaccatcacttaagtgtcctttgaaattgaatttgcatgcacatatttactgctcattctttttaagtgagtaggtgtgctgagcttcaagtctattttgagactcagcccatgttaaccccttgaggcccacttcatgataggtactgccctgtgggaatcctgtcatttagtgaagcatgaagccataatagatccacagccataccaccattggggcatctcatttcgattaattccctgaagcctttggtgctgtggtttgcagaaatcaaatggcgcaaatgagaactacaaaattaggcaggttaaatttcgcaagaaaaaaaaaagataagtagtagaaaaaatagccagtgtaaaatattagtacacaggagcagtaagtaaactaagttccacactgaaagaaccaccagatctcgagaagtagatatcaagaaacagtttgcactggctgttttatttccttatgtcagaaggaagtaggtttttacagatccttggacatgatcatctttgtttctgatattcagaaacggaaccaacagtttggtgtctatttattttatttggtttgtttttgagaaagcgagttaaataaactcagcttacaaataattaacagcccctggactatttaaaacctgctactgaggtggtagagataagttgaatccaacagctgtcacatgtatgggtttgacagataggtaagtccaagagtggacaaattaaaagcatttttcatatgctaatctccacctgcacaggaataattttttttaaggaggcagtctactggcagagcaaattcaagagctatcagtagtacattacttctaggaattatgacatgcaataatgaataaatacttctatgagaaaagtctgctgtggaatcttaattccagatgggtgtcctgacagcaatgtgccagcaatattgtggaaagaaaaatgacatatatacatacatatatatatacacgcacatatgtatatgtatatatatggcttttaaacttgaataataatttcttccatgtgtaataggttcacaattatatctaaggaattacttttttagttgcgaatagagatcaaagtgaaaacaatagtcaaccttgcccttcaggtggcagttacatgtgagctgcatagtgagtgtgagagacagtcaaggatgtcaatcagaacctacagattaacccacagcagtgaaatctgagatggtttataacaagtagataacagtttcaggcctatgtgagaacgcataaactaaaacttcatgctgggacaaaacagggcaggacatttgaggtagagagtgagaaaaccatacttttattatgacaaagcctctcccatacttgttgaaatgtcactgggttgttattaaatgctcaccatttctctaggttttatattatcttacaaaaagcttttggagtttcctttaattttgataaacattcaaatttgtgcataatttctgcacttcagctttgaatgacagaaaatttcccatgcttgttgagtttcctttcaagtaagaaagtaattcttgtaataaataaaaatgttatatttctttcttccaatgttatcaagttaataaacccttaccttagtttataaagtcaaaatttactaatgtattgaaatgagaaccgaaatactcaaaaagaaatcttaaacatcaaataataacgagggtaatgaatgaatggtcatggttatggatggtgatgatctaatgtaaggtcctatctctttttaatagagagtcctcaggctcagacaatttagggttaaagtgcctataaccagatcagaatcctcagttattacgtagtactcttttaagacccgtgaattaagttataatcaatgattacaacactggtatcatttattaatgtacccttctcttctagggtagcagagatcagtttctgacaccttagaactcttcatgtgcaagaggaaattgaaacaataacaacatatttaggcagtaggcaaaatgatttgctttggctttacctacagggaaacttgggcaatggtcattagacttttttaatggaacttcaagtctgatgccttgtgaccaggtgctaacatggaaaagagttagcatcattgacattctttgattcggaagcacataagaggtagataaggagacaacacaggcgacccacctccaggccaggagaagaggacagttcctggaatgtctgcaatgtgttactatttttgtcacacctatgtgaggccatccatctggtctgaatcaatcagtctcatcccagggctctgctcctctcccagctgaaataatacccttctttcctcagtgctgtcttcaggaggggcgctgctcaggactgcccggacaaggccaattaatgagcctgtgtatttgcaaacgatgacccaggattagacactggagaaaactttctttaaattctctataaactctgctctcctagaaacagtacttgagaaaaccggatgaatcattagacaaataattgaccccagaaagcgaaagactgatgctacattactttgcatacgtacatcttattttttaaagaaaatgtccttgccttgaatttaaaccatgaattggtctgctgttatacccaaagtagataaagcctgggtgtgaggcattcaccatgacttagcctgaagtattttcttcggccacttcactctcctccacgctacatgttcaatttccctgcacctctgtaacaaccctacacctctgcttctagatcatcttcttggcattcctcatgtgcacatcctgttctctagcagtcccttatccatgccgcctcatcagattcctgcacacctgacagcctcttgcttgctatttcagctactagactactgacctctattgtacatgcctgcaatcccagcactttgggaggccagggtggtaggatggcttgagcccaagaatttaagaccagcctgagcaacatagtgggaccctgtctctaccaaaaaaagaatcaaggtatgcaccagttaagccagccacgttttaggaccacatagcactcttcccacaagagacctcaaaacttaatgacactggctttggcaaattcaataccatgacataaaactactcattttccctatctgcctagttttccattgcagtgggaaataccaccctatcgtggacctcccaaccaggaaccccatggttatttttgtctcactgctgtctttctcactccccacaaccagtctgttaccaaccgttgctactttttctttgccaatgtttcctgaatccacccctttcctttccattctcatagttgtggtcttagtctaggctttggccttggcccatggggactttgcagccttctttcccctctcccaccacattcacatatcaaattccagcttactttatttaataacactgacaaatttttttttctcttgtctatgtttttggtccattcattctctctgagctccattgagactgccagctgctctctggactggcttctaatgttcacttcatacatgtcacctcttcatccagctacctcctaattgttccaatctttttttctttctttttggaggtaagctcttctggtacttctttttttatcgttctcacacttcttcagaaactcttctcatggtatacatgttcctggtacacaccactcaagggcagattctgacactttctttcggtagtccatccgtgcttcctttctgatgtagcaaagtgtcctctttgtgagcacgcccaggttcaaaacttccatttccaccacttgctacctatgacattgggcagttacctgacagcacttcacctcagcttcctcatctgtaaaatggattgttgtgatgagtaataagatcatttatttagagcactgctggcacacagtaagcactgttaacatgtttgctattagtattattatcatatctcataggactccccaatcacaccccgcttcaatcaccatcatgctgtatgccatattatccttgcatgtaaattttgaggaccacataactgggttttaaaaatctggttctaacagtagtttatgtcttagaaatcagggcaaagttaatcgaagatacctaatatcaaaccaggtaaagatgaagactttaaatgctttttgaggatgattataaagaacattatgataagaatgatgatgatatgatgatgatgatgatgatgatgatgatgaagaaaacatgaccaaatgcttctttgggttaatactctgcttataaaacgaagtgtccaggaaacatacagtattcctcctgaaattagtttttttttcccattaaatggaaacatgttatgcataagaacatatattgtgcagtatgcatgagatttatttttcagaaagcagagaaatggcaagaattttaagtgttctacatacttatttagatctcacatcaggagataaaacaaatgaaaactctgacttgttaataatttacgttttggtggaaaattcatacaagctgttaagatacctctaagacccaacacagaaaatgcaaataacatatatccactgtgcactgaagaaaatttgtctgaaaagaaaataacatcaattaaaaaaaaaaaacacaagtgatttcaagggaatgttgaccacatttacagggctgtaattgtgcttattaattttagatgtctcttttgaaatattcgtgtaaatgatctctccacttaccaggtgtttcttacagaaagtccactgggctacctcactacctaggaggtggcttacaaataggggatttctttttagaaagccacaccattacttttctctaacagcttatgcaaaagttttgtgggggagggaaaaacccaagccaaaaaaaaaaaagaaagagagagagagagaagagtgtgcatgacaataactacctctgtcccttaggtttttgttcttttcatgtcatggaactttttagctgtgctgcctgggtaactgctctggaaggttggaatatctgttgttgaaggaggtttgtgattgagggccctctgacacaaccttttgttgcattgaggtgtttgatcctctttccctttcttctaaaaccaatcccatccctttaaaaaatggataaccagcacttcttttacttattgtcagcttttggaaagttactctgggggtttgtagaagtttaactagttaactctttgcatgctgatgtcctgtcgctaaatattcttcttctttctaaacaggaaggattttaatcacttatatcaggtaactaccgctgttatgcaggcatagcaagtgaaacatattaaggtccagaaataaagcatttgtgttcaaggtcttcaaatgtgagagtgattcaggctttgcaatgagacacatccttattttctttttgtcctagaaccgaaacatgtgagagttatgactctgccacttgaaaaaacatgatgatatactaatttttcattgaagaacaacaggctttggtaataagtaaatgcaaagggttacttcagaactggggtacataactgaatggcaacaaagaaagagagccttagaatgaaaagtgtaggggtcttgttccagtctgctgactagatgctggaatatttttttcccaaaagaagggacacaacccaggctctaggaaagaaaagaagcttaagtggattatttaacaaaaaagcaacttatggcttctagatagtgacctacattctgcacacaataatgatgttttacggtggtgatagggttaataacctaacatcattcatgtagtgttttttgaaaattgaattttactgctacaaagtaaatgtaacagccctctggagacaatattacaggcactttattgtttgctaagctgatgtcatctttctacagactgactttaaaacaaaggcagaacatttattacaaatatcactgtgtgaaaggaaatctactgaaatattgtttagaaggtgagctgataaaaaagtattaatacttggctttgatcatcttgtactataaagttatgacttcaaattttttctcatgtgatctctattcaaggcaaacttcatcctggcaattcctacctgtgtctctaacattatttgccctcaagttgaaacatttgtttaagattcatgcgtgttttaaatacatttttactctctaaggcaatttcttaacagagttgatgagtttttgagagagagagattaaatagcatctttcagagataatatatgtatgattttaaaaacaaagtatggagattaagctgtttagtttatataatgaactttcaaaatcacctgtaagtggtgactgcaaagtttgcaatttaaataagctgtttcaggcactgccaagcaagcattctgcatcacaggttgcttgcaactcagagggtttggtctctgtatctgatgcacgtgtaatacagcgtgaagttgtttgtggatcacacaggagcttcttagagcttcatttccacactgtaacccttgaaaatgtatcaaatgagcagatgcacttggctcttccttaaaaggcacaagtaatttgtttgtaaatcagttacctttcaagaaaagttaaattagggggaactcttgtttctttgatgttttccctcttagaaagccaaagagcaaattaatgatcattttgaagtaataatgataatgaggaaaatataatttagtgagctacactatcccaaaataactttttcaggtacagcatataaataacagcccaaaggactaaagcagcctgatggtgtttttctaagaaaatgatttactgctctgcctttgtctctgaactctggttagaaggaaaacacaggtcaaggaaattgggttaagggaaaaaaagcctgttatgggctaggtgtagaattgtatgaatagtgactaattgggagtctgtagcactcagatcagtgtgtgcaatgctcagtactggctgatggtatttatatcagtcaaaaatgaagctggatacatctttgcgtgctctacgaaggcagtgtgttagttggtgaattggccgtgaccaggagaaagctaccagtagtactatgattgtgactaaaccaagaactgaactgcaatgttttaaaaatttattttactaataagtgtacttctgtatagaaaaatcatttttaaaaaaccttacaactattttgaaacattttactataagcctgcctttgatttgtttgggaagctattttatagtcactcaattcatttattgtatttgacaaatattagctacttaccatgtgccagcaccaaaggttcaaaagtgagtcctcacagagccttacagattagtgtcagaaagaactgcttggcaagggtaagagtgtgacacattgtgagtattcaagaaatgtttgttgagtgactgatagaatgaattgagggatgatcaaggtaagtcctcgatttgatatatgtacaaggaggaactaagagtttccctccctgaacaggtcagaaaggacatgcttgagctggccttaaaaaaacacctgagtggcatgtagcatgtgaataatgaacaggaatgagccactggtggtagaaacagcatcccagaatatgctctgagttttagcagcacagcccatttctgacccctgcatgcctcaaagccactttaagaatttggtctttgcccttctgtcctcaccccctgttgtactgtaatacacgcaaacatgtgtgtgcatgtacacacacatgcacacacacatgtgctaactccatcgttggaattcgactgtccaccccttcaagaatcaaagcatctcctaaaaaaaggaaatggcatgcctgttccttacttgtatccataaaactcacatttgagttgtctatcatgagacctcagttttttgaccaaacattgtccttaagcatcagacacataagaaaaactggaaagaggaacaggtaatatttaaatcacccactattcttgtaatgaaaggatttttcaaacatcaagatgaaatggttttatcaaattattaaagtttgctttttgtgtccaacttagcaacaagtcatggatgggacactcaaaacaggccaatttgggacagttccaactgtaggaggccttgtgtcattacctctataaatggaatcgagcttcccttcttctgcagctatacattttcttgcctttgatttcccactctgctttctctcccggcaggctcttcctgtctcctctatcagttactctataggcagatgtgcctctttttccatttgccagatccccccaacccagatcttccaaactactcccctttgaagtctctattaccgatacaatcacttttgtttcccttccatcccctctctcactgctccagtttcttctctccctaaccccattagttacatctgctgcccctaccattcagcctgtgttaaatcgtaatgcgcttgacataacttcagtttgtctgctaagtactcaatcagcacgcattgctatcttctgatttgtaggaaagggggcaagactgagtaagctggctcagaattctctgagtgattcagctctgcccaattagcacaaccaaagtgggaaattgacaactaataataatgaaagaaatgggttttagttgtgaatataaatcccacaaacttggttcctgatgcctgtggtagatactgtatgcttcatatggtggtcagatggctcagagaatgcagaagtggatgaatgaaggagagtgtgtcaataattgcaatatttattagttgactgggattctttccctggaattcattaatggattttttaaagactctgcaaaccaccagaaattgtatgtaacatttagtatattgatgcatttttttcctgggcagtgggtccatacgtttaagcagattcttaaaaggctctatgtctccccactatccgcctccaaaaaggtgaagaatcattgctataagtgaagacacctatttggtctatgttttcatgtggtctgctttttttcccagcccattttaacattccacatgatttgagcagttcagagagtagaaacgtagggttttaaaggcaaaatttaccttctttaagaggaaaaatgtttaaaccacctaccaggttatacaattcacattttaaaaattattttagttttaccacaattcaaagacaggcctttttttttttatttaacaatgggtataatcacacatctgaacataagaattagttttatgcagttccatagaaaaccaaaatcttgaggaacactttcaaaacaaccagagaaaaataaaccattccttatgtcagtcttgttagggagggattaagaaactggcaattattttggcgaccttaattgttgcgcggcaggaaaatatgtaattagagcacgttcccaggcctgcacacctgcagcacatcctacagcataatgtcagctttcagtgcctgtcggtgccaggttctagcacaaccagtcacagtgacgctctgagaacatttcggactcatgtaatgtggcttctgtgtatgaaagaagcaggcatttacactaccacacaatggagtgcattgctgcaacactggtttcattattttctgacgcctaccttcagcactgccctggtttactccgtttgaggttttattgttacggtataatagtcctgtacatttttgaaattcccttattattcagcttattaatacagtactgacttgattatcaggctgcagttgcacagcggaagattcagtgcattagctaagtcagaagctgagtaaattcttggtataatgagaacaattgtttgacatttttttatgtagaaagatgggccatggtagttctctatatagttgcattttggaattcactctatattccctatatgttgttgagtattcgtttttcatataaagaaagcttaaaatgtgttctcactaatttgaaaagtgtttcagggtatgggaggactccatcatgattctcattagcttttttcttctttttcttttattggcttttctcaacaaaaagaaactctgacgttagaaaaagtagtgaaaatgaagaaacagtatgcacgatgcctatttttcagataattccataatctggcatagtgatagttaacagacttttcccccctaagggagatacactgtattttgctatctgacatgttgtcatatataaagaaatcaattggtaattaaatgatgcaccttgtgaagatgacaaaaggcatttggttgcgaaaagagaactgggttttgaggggtttgtagtgaaggcctaatgactattcataagagattttcagtccgttgatccacttgactggaaagttctgccctggagagttagtgctgtcagtttctctcacctcagaaagccgccgcaatcgacggtgtagaggatgagcgagaaattatctagtagttgctctaggcctgtcttaggtcacgtgcagaaggcacatctggcttcctgtaggtacaacctcaggacataaactttgactaatttttaaactataaatatgtacgagtgacactgaataagttaccttttattcatatttcctttattttagaatgcatgcaagttgtgtagtaagctgccattttggccttatttttcttccaattttaactgttacacacttgcttgttaagctaagagtgactgtttatgaaagttgtcaaggaccaaatgataacagtctccttatgtgaaatccaacaactctgtgtttgctgagaatatgccaaagttgccctgcaggaagctcacctgaaacaaatacagagtatatgattggatagcgctcttggggggtgtttattgccctatttggcaaaaggcagtaagatatcaaaatgtacatacataggactggatacaaggctgccaccacatcaagatctctagaattgcagaacattgttgctccagtgtcttcataaacacaatcacaaaaactacgatgaaaattcatgcattcaaaacagaccagttactgtccaccatggaccaggcaccatcctagctttggaggagacaaacatgagggaagtaaaatctcagtgctcatagtttactgaggaacagacaaataagaaaacagttacactacaacatataaagagttatgattgagttgtataatagcacagagtttagaatccaggaaagggttttctgagaactgttggggtctacaaacggggtaaagatttcttatacgagctactctttccattgccaaagccaaattagctggcggaaaggtgagttggacaagtgaggtgtttctgttgcatgtggaatctcaacagaacagtagtggccagcaatttctgtacatatttactcttggaaagtgcttctccatgttatcttatcaagaagctcacctaatcaaaggtaaacacatttatcgcctcattaaggcttgttttatggccacttcgatgtcatgtttgaggtagaagtacctgtcacagtctttgtctggaatgtatgtaaaagggatttcatggacactgcagaggttttaatctttcaatatcaaaataatttaatgcataatatgtatttgagaagatgtcactggtgattcctacttgtgtactgtgtgtactgagttttgctgacacatttgctagagctgtcaaggtggaccaaatgaatggacagatgccaaaaaaacaattatgcttattaatgtacattgattgcttgtttaggttataaaacaaattaaaaaaaaccattagtatttaaacccttttatagctgagctaatgattgcttgtaatatagtgtctggtaaagaatattctataatacctgtaaagcccagctatgttatctaattagtagactttgatttaagtggctgtaattatggaattgaatagttgcctttctaaataaccaaatggtagatttaaatatataaagatgttgacttgattatttaatatttgtagcaaagacaaaccacctaaatagagagattaattccacatcagtgcaacattaaaagggagagaggatgccaagaatcccattaatttgggatataagtgtctgaaatttcctcaaaacatttacgccaaggaataccaacaagacaatatcaagcagctctccctaaggatagagaggtaaggcaaacatgattttaaactgcacaatatcacacagtaaaattaaggacaatgtgttccaccagatgctaaacacagccatttatcgagctacaaggttctagactaagtaagtgttttgtatacatattagctccatattacctccatgacctctttccccatgaagccttccctgagcctcagtatccactctttcctgtaccatgaatccatttttcttttactttttcttttctttctttcttttctctctctctcgcttgctctttctttctttctctctctgtctttctttttttgttttttgttttttgttttttgttttttgagacagggtctcactctggcacccaggctggagtgcagtggcacaatcatggttcactgcagccttgacctcacaggctcaaaccatcctcctgcattagcctcccaagtagcttggaccacaggcatgcaccaccatgcccagataatttttttttttattttttgtagagacggggtctcactatgtcacccaaactggtcttgaattcctgggctcaagtgattctcccacctcagcctcccaaagtgctgggattacaagtgtgagccactgcacccagcccatgttttcaataaagatggtgctatttgaaactatggcatgtcacgtgtatattattttatttcaccatgtgtttaaatgagataaccaggtgccaagaaagcttcaatatttgcttaaatagccaatgtgacggagaataggtaacctcttttctttttttttcttatgatttgctttggctattagttttgaaacatacatgttatattcccaattagatctcgttacatccttcacaggctgtccaaaaatttccatacttctaacaagaacttcggttgactgagtttatattatatagtttttctgtcctttgccctatttctttcaaggcctttgagtcagaagcattcagcaccacggcgtacgatagccaccatttgctttgcccttttaactttgggggttacttctgaccatagtccaactgctcagaagggctttttcacaaattgtttaccgtggcagttgctaccctattggggtttgcattcagaacccataagcagagagcaatggtgtcagtataacaaataatgtgtacaattttttaaaatgctgaatttaccaaatccccatattatgttttcacactgctctttcagaaactgtgctaatacaatactcctataaactgatcttggtcctggcaggccctgttggaactaatggggcctgacagttcttcagttaaaaattatacatgagggccactttcccttaaattatctattgtatgccagctgttcacaactgcactgcttcactttctttgcagtgctagaaatgtctaattttctcataatatccatagcaactattctcatggagggcattgaagttagtaagacttcaaacacaccttcacagaaatcatgctagagttgcagtttccattttctttaattttttggttctgaaaaatgtttagatggctcattttgccggtttcatgccatagcacttgagttatatcataatttctcatttgctgcacaactttattctatttttatgctcctaaatgacgcagctctaagtacccgtgagtggcacttccgtgctgtgagtgctatcaaaggcaacctcagatggataaaactcctggttttttgttttcttttgttttttgttttgtttttgttttgtttttgctggggaggggagaagcggagtcatcaccaagggccttcttttgtttttcaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaatcttttggctgttaaggagcactctgattataactagttgctgtagaaacctggtcatccagatgcttatcaagaatgcattattattttttaaaccttggtggagaagccacagactgcagcagttggacaaggtcacatatcgatggaagtgacatgtctttcctctttccattgtgtgatcgtccagggcctgggggcattaatatgcaacggttctgtttttctttcagaaggacttgtaaactctttaaacagaggcacacagttgcaattgttgcggtactgagtgggtgtatagaagctagggctgcagccttgtccagttgcagatagaataaaactgacaatgatgcaatgggcctggcatgtagacaactctgtgggatggatgaatggtgcggctctcgctgtccctccggtggtggtaggccctgtaatagctagcgtaggaagggtggtgaaaattgatatgcactattactacacgtataaaacttaacactggggccattgcacaggtggggggttcctgtttattgatttttatgagtttgttagaacatgcgcttaatgcttttatactccgggagctctgggagggctcaccttaggtaataaacctttccgtactttgcaatcgctcacaatttacatggggactcacattatccagtacaaagcccagcattccccttctacttggttttaggagtgtgataaaaaaaaaaaagaaaaagaaaagaaaataactatagcacttactttgaattttttgaaaacctgtccactcccgctatgaaaatggcccctaattctaattactcatatttccaagaaaaattagtcacacaaacttatgttatgtgttgtctcagaggttgaaagcaaatcaggtttccaataagacagtacatcaaacaaagtagcatgttcttgatgccgatgacttttttttagaattatggttggacatttttggcagacagattgtcttttgctctatcaaaatgacagtttcttttgtaactgcaacattcataattagaaggagagaagcaatctgcccaatttaatatactaaaagaagtttagagtctctgctagtaatttcattatttttaaatttgaattaattgacttaaaataatacagttaagaagtataaccagcaggattatggagaaaggtttctttttccttaaaaaaaaacagtgctctcagtgttacacttaagatgagattgaaattttcttttttacgccaggtgccccgttctaagattcagagcagcaatgtgaatattcatccttgcagtggagctgagagaagttgtagggcaaatcctgggaacaaggtcactttaaacaaaaaagttctccaagtttcccatgcttataaggctggctgggcttaattaaagtcaatggatgaccaaaaaataaataaataaatagagagagagagaaagaaaagaaaatgaaagaacaaccacccaccccatatcagtctctttctaggcctcacttcacattgtataccttagccgttgatgttcaagctctttacatagatcaagaataatatttcttaaatcccttaacaacactgacgtgtccatggtttaatcactcttccccagtccacatctctaacctacgtcacttgggtggccctcacccacagcaccacaacaaaaacaaagccagaattgcattcagaatgaaatcatcataacatagcaaccttgttcaggatgtgacctttgggtttcagcaaccctgtcttatgcagccctggccaaccttaacctttcctgttggctcggagggtaacctttcttcatattttcttcaggatctctccttacgggacccagtatgttgcatgcctatgatgcacagggccaaaagtttcggagtgttaaaatctacgagcctgttttcctctatgagagaatgaagcctgcactcattttaaagaatacatacgtagcaagatctctttttacccttcctgtataattttggttatgcttaactctaaaggaaaccaattctctttagctctgttaccttatttcgtaccttagctgattgtcatctttacatgagcatcagatatggatgtgacaaagattttttagaaataataacgaccagtgctttatgagttgtgaagtgtttttctctcccacaagaaattacaacacaaagtgccctatgcatttttttagtatgttgataagacagcaggaaattttttaaccctcaaaactttctgattataagctgtgctctaaatttacacgggcagtgttccaagtcccacactcctttacaagtatatcattacagacctgcaagtgagaaggtaaatttccccatggcagttctgaaatctgacttcaggctaagaggccatggactgagagggctgattgtgctgggtacctacatatcaaaatctcctctagtattttagtagttccttctgtcctttttgcagccccgtgtcctacagaagtgacattttgttccattttcatttatcttactctccttagttgtatatcaaaagatatacacatttatataacccaagaagccagggattaaagcacaatatttcttaacacagcttcctctaagatctccagtagctacctaatgcttaaagcttgggctgacgtgggttatggggttatagtagctttatagatatttctatttgtgtatgctatgtttatatatgtaatacatatatgtgtggcttagggctatactgacatgttattttctatgtgttcatttattataaacagcaggcaagcagacgtttcacctcacacctcactctggtctctatcattcaaaaaatattgcaagattcccattctaaattaaatacatccgagcttacgtcttttatcaattctttattcttggtatctcaaaattctggtcttcgtcctttgtctcaaaaagggaaactgctgaaagcatttccacctggatgtttaaattatttaagttgcaggaaccagaccttttccctcctgagtagttgtgggttttaaaggctaaaattgcttcatcatgccaaagtgaaagtatgcataaattatttagttaaacctgagaaaatacagacttttcccagtgatctttcaagggctgcctacttaaatttcagaagaatgggcaagatttttttttcattctcttagaaaattgaagtatctcttgtgtcttctgtcagttggaatgtgaacaaaattacaaaatggtaatttttttaaaattccaagcttcataatatccagtatatctatatcattccaaggtgaatactgtgataatcaatcaataccaggaagactcctccagctggcgagaactgcaaaccctctctcaatgtattcttaggaaaatcaggcaacttgttataggtctttccctagtgccaacctaaagactggggggcatttccgattcaatttctagtcatccagagttggtatttcagttttaaaagtagaaagttaggtaattttaagatgttatgaaaactttgttgacatttttaatttgctttttaaatttacctttacttcagcaaataaaaataccagaaaagtgtgaagttgtgtggtggtggtggtggttggggtgtgtgtgtgtttgtgtgtgtatgtgtgtgtataagatagataatattaaagtagcaatgaaaacagcccagaaatataggcaattgaggcccaatttcaagtttctgtagcataaggcatgtatattacagaatgtaccacattatgtatctgatctctaaattcgccttagtataaatgctccaagtacattcttatgaccaagaaaagaatggtatttttaattgaatacctaacctcaaatcctgaaagaaacattaattgggacaggacaaaatgtcaacaaaaaagtacttatgtgagttatttagtatacagctgtctgttcatttgtagaatccatttgaattttatgttcagagaaattgggagatgagagtaaatatggggggagattggcatgtaaatttgttgagttttcatgaaaaaataaaaatttaaaaaaccttccaagcaaaataaaacctgttccattcacaaatgatggatgtcactgatcccattaatacctgttacataccaggtcctcttccttatatctaacttgctttttctcccaatttcagtgtagttgctcttgaccttgcctttgttcttctctcctccttctctcttctgcccaggcacagttatgtccactaaaccagatgaacaagatttcatactgacaccaccatactctgttaaatagttaaaaatcctattttggcttttgtttgctcacttagatttgtacacccaaggtgatgaagagagcacagatagaatctagagacaaatagtttctggagtcaggaatcagatccagattctaacacgaggtgatgtgggaaaaagtcagttaaaatttctgagattcaatttactcatctataaaatcatcctcataataattgctccccccttcaaaggtttgttatgaggagcaagtggaaaaatgtctattaacgggctctgctgtcagtggattaatgcataaatccaggtattattatataatcaaactgtccttttaaatgtagaagaaaagggtttttaaggcacacatgagattctggaaacgtagacgttatagaaagtctatagggactaaaaatgcattgtcttctatatgcatttatcttgccagaggtacatgcagacctttggggggtgctgctctggccaggacagtggtggagagctctgactcttgagtgtgagagctggaacgattgagaaaagacaggagggaaacttcgaggtcaggtgacttctttctaactacagcaggttctcagatccctaggctggcccaagatgagagaacagtcaccaaagagagtctggcacagtaagcctaagtctcagtgtcatctgattgtgaaatctgcttgtttgcatactcatacagtaccagagcttaagccctggccactgtacggatgactgtacaagagcagaatctaagaccaaggggttgtttttactaaggaagaaaaatttattagagttacttcaaggaaatctattagattatctcaccaaatacattaatagcatcaattattgtattttacataattttttttacaccagatacacagtatattaaagaatttgtggaagtcccccatgtgaaccagtattaaccatgataagagtaatcaggactggcccaagaaaggtagaaatgagaatttataaacttgtctaattctcattgcttgaagaaaattgaaatgaaagaatccaaaaagggatttatgaatattttttaaagcttaaaaagcccacatacttatcatcgaattgtctgcttacgataggagctggaagagtcccttatatccactcaactgtacttacattttaaatggttgttttcctttctcttacactactacaagagaaaggaaatgcctaggcaaataaactcagttaaaataactttatggttgtgacacagtttgacaaaagcaaaggaaattcagagtcactgctcacactgtatcctcagctgattccaactgtggaaaataaaatgctttaaaaaaaaaaaacaatggaacaaacttgggatggatttagtcttagtcttagaggcagccttcttaaatgctgaatctctgagttcgccatctttaagttcttataagagttgcaatatctgtattcatcataaatctagtcagagttaaagaagagtatttggttaagtactgcttggaaaatatgttgtccttttttaagattatgtgattctaactcaaagctgtaacttcttgggggttaataacctaccttgagatatactttaagtaataataatggcttcttgggattaggaaagatattaaacttacccatttccaacgatcctgtactattgcaggagagatgtggggagggagagaaagagaaagagagagagacgagagaaacattttgaccaaaattccatattcactattgctatgcaaattataaacctaacagagaggtgatgtatcatttttattaaacttatgctgcacaaatagtgtttacatagaagagtataaagttaattccctcccgggaagcatttctaaaaaatataaattgtattttgagagttaatcaatttgttttttctcttttggcattttaattgaagcttccaaaccgtatgcttcctcaaagtatcagaaggcaaatatcagtcgtgtggttataaaatcaactcttaattttctttcaatgaagtagcagatagtcagcttgtaaattttacctacattactatggagctgcagtgctataaattcaaaacagtgtgcaggttggtggaaattgaggtccaggcagcaaggcatgtccataaacttttctcaggttattggaacagaacgaatcaaaagcggttcctggttgtatgatattctcttttgatagagcaggctgcttgttgttagcaatccaagtgcagaggttagtcagagcagaatgtaatttctagcaatctgacagacctgcggattgaagcggcaggttttcccttccgatttcagggaattgcttcttactgtgacaaatgattagctgttatctctgactgaatttgatttctacaagcagctgagtcaggtaactttgcagcgtttgagggggttttttacaggaaatgaaatcggctccctagtcatatgtggaccaaatgaaatcttctctgtcagggcaaaattgtgcttttggttaattgaaggcagatttagcatagagggtgtgtgtggtgatgtgtgtgcagggtgtgtgtgtgtgatgctctgatggtgtaggcaggcacacccatgtgtgtacatttacaggaacgagggatcatttcatggattctctcccaactttgaaaatcctgggttcaaacaaaatccctacattctgagcagggttgaagcttttagaataaactataagtggagacagtcatgtgggtgtcagaataatgagccttcatataaggacatcctgtttcaaaagagtttgaactgcaatattaatcaaaacacaatagatactcactgagcatggttttcacaaaagtattcatcaaagggcagctgcattcaaagcaagagatttaggtaaaataagttaatccttgatctcatccaggtttgtgtgtaaattttgaatagggaggggttctagtgatagcaagcgtcctctggatgataaaacaaaaaacgtggcatgggaaattccaggtttatcttgtgcttcttgttcgcttttgatggaatcttaatagtgactacacaattaggatcaggtttatccttctgtttatagtttgtaattgctctggaaatcctgagtttcagtagttcaacttttagtttttaagcagtcggtgagttttttaaaaagttactatcggataatgtttcatagtttctaatcctattacagcaatgtaaaataaactgtatttcccaaatacgaagcaacatcttttattcccagacctcttactttgcaaagaggaaacaccatctttaaggtcatactagtaatactccttattttgtgatgaacataatatactttgtttataaatcctagtttaaaacaacagagatttgtggtaattgacgaagagtaaaaaagtcacaaatactgaatcttcatttttcagatgtgagcacaacattcctaggtatgtactaatatattctaacacggcattgcgctgtcatcaagacttttgtctaaatgtcaccactattatgagcaatacttttgctaaattctttagttgtattccctaaatggcagatacctttggacctctctctcattagctattaaaaagaatagttctttgaaaataacagttctgtgctccctaaacttcttttgttttttgttgagtgatgtcaacttagagttccacactgattgcccttcctccttgctttgtcgccacaaaaggggtgagggggtgccggagtttgacccacacctctggttagtattaatcacacagacatcaggtaatcacctaagtgcactcagacatactaatagaatgatttacagaccaggccctttgtgtttttctaaatctcattttaatttatttaaagtgacagtgaagctagactccaagctaatgagtctgcataaaaatgatttctttttccacctttgtgtttgctaaaactttctgactctgaaatcctgtcagtgaaaaattatttgagatgaaacactgcaaaagaaggtaaggggaaaggagacaaagaatatgatttgatcatcagagacctgccctgggtccaagtgggcctcatggtagccacaagtgtccagatcagacaaatggggacttttgcatatatgttttagtgcttcatccagacttgagtgcttcacagagtctgtgaggcaactcacatcctttggtagctaacaaattggtcctttctgaccagcaagcagtttaagaaagctaagctgtgttgtatgcgtattaaatatagcacgaactgcttggctttgcttaaccttagttgtattaacagattgtttgttttgatgactgcgccgttagcatgccagatgataaggaaatggttttggattagttaggacctataatatagaaactaaataagatgatagacttacaaggatatacatttcctgtaaaaaaaaatgaattcccttatcaggatttacttgaaaggaatatgtcttattacagaaggagaatgccttgaggaatgtgggaaagattaaaggcttttgtcagtagtttaggttgggaccaggtttcctgtgtagccagcccccctgtccccacgtaaatgttttgcttttcctcctctctctctttctctttaaggggaagagtaagcccttctcgctgcctggcggtgtcagattaaataccgagatggcgacaggaaaaaggctggaaggaaaaacaaaagacaggggggtgagagttatcaggttggcgacggaactgcaggcttgtcggactccaatttacagaaatccaaacagattttagttgacacgatctgcaatcattaccgccggagcagagctaattaagaaattagctttcctgattgcctgttctcacagtgatgagtagttgaataatgttgtatggctgaaatgttctaaaaccagacagtttaacaagtgtttagccttttgtggtgatgctgtatttactttatctataatatctgtgctgcatcactatttgtttcctctccttagaagcaccccttgactttttttttccttttccttggttcaccctcttcttcttggcattaagtcagagcttccccccttacttcagccgcgtataggagagaattatcatacagatttgtggcatgtggtacagaaaagttatcggaaacttgtggcacattcaaaagcatatttcctacccgtctaggcatttttcacaagaaaatatcaggtccaaagtggcatttgaagtttctgaatctgactaaatgcagaggtgattgtgaataaataacattaaaaggctttagtcagcaaagatacagtacgagtgagtggagctcattagaaactagccgtggaccccagatatgtcaaaggggggtttgctgagaggtgaccacgcagtcttcataacttcctcatctctcccacaactatcaaacacataggaagatgttatttggagaaaaaaaatagttatgtttaaaaagcttgacaaagaaattaatcaaaatgagcttcatggaccttgtaaaatatggtccaggcacatgtaatgcatatgtaataggcatgcgtaccgatgtgtccatatggacaaatagaaaacccaagagttaaaagtttctgcaaaaagacaacaacttctttccaaattaaatagaaggcttatttgaatataaactttctcgcaatacagcaaaataacaaagattggacaaaggtttccaggtgtcactgttgaaactgcaatgggaggtaagagtattgctagcttcccaaatgaaccacagaaggggaagttgcatcattcaagatgcttatcctttaggatttccaagttttaaaatgtaaatattcatctatggaaaaaccaaaatttccaagttttcctagtacaccttcaaatcatttctacacctaagaaaaataaatactaatttttcttaatgaggcctaataacacctttaacttaccaatttaagagacgctaagtcaatacaatgtgcaggtcccttctggatatttattttcctaagcacaaattcatttataccgaaaaaacagtggatgaaatactagaaaaatcttttctgcactggacctctcttttccagatttacctaagagaatcttaccaggaatggagatagacttttacttcctaagtagatttaaatttaacaccaatttattcactctagtatttctatatgggaactaacagcttctataggacctctacaaagtgccagaaatatgatctcatgtgtagtaataaatttaaatgtgttttcttttacatattctatccctccgtattttcccaatctcttccttttttatgactcccccactctcagtttctaaaatcacttgtccactccggagacccaggggcactgcctagagaaggagctaactttaaaaaaaataaaccaggctggtcacagtggctcatgcctgtaatcccagcgctttgggaggccaaggcaggcggatcacctgaggtcaggagtttgagaccagcctggccaacacatggtgaaaccccatctctactaagaatacaaaaattaaccaggcgtggtggtgggcgcctgtaatcccagctactcgggaagctgaggcaggagaattgcttgaacccgggaggcggaggttgcagtgaaccaaggtcatgccactgcactccagcctgggtgactgagtgagactccagctcaaaaacaaaacaaaacaaaaaaagcaccatactcagagctgctataagtaacatgcagttgtaagccacacacttctttgcatgattcttattttaaagattggaaagtagaattcgtatttgtttgttgtactaattccagtggtatacctggaattaataaatggtactaagacactaaggcgttactttcttgcattattctaaatcagagtgttgattagagagaataatccaaaggtaaaatagtcagataatttatttttatgtaagtttaaaaagagaaagagattgatttttttgaagagttataattacattcagtatgtaccttttgtgcattgaaataattttagattttctgaaaaggaaatattgatgtaattcagctctcaaaacacttgatgccatgcctttcttcctagtgtttatgtaaaagcaagtggtcaattgtcgctgcatcagagctatgacaagttcttctatattaggtgggcatcactcaaacacttttccatagtagatccagtggtatacctggaattaatacaatttattaagtactaagctatgttgtatttattgtattaattccagtggtaatacaattccagtggtaatacaatgtattaattccaggtatacctaccactggaattaatacaataaatacaacatagcttactactcaagtctattacacgccatctaaaatagctaatcagaaaggctgtatgtctgaaacacccaaaagtcactcatcctctttcttaaagcattaaaagttttggcaacttttctgaatccgagttgtgtgagtcctatactgtactaagctggacatcttaagggctgcaggttttaatatttacactgccccgactcagttggtaaccgctagcaaatcatctcaccccagtttttgtccttttcctgaagaaagctgaatttggtttcatgatcactgtttgctgaagaagacagtcccaacaatggtccaaagcaaggccagcttttaaaacagccaccaattctgagtcaaggcatctaccttcattctaatcaagaagggaagatacaaagtttcaagaccagtcttcaccttgcactgaatctgacggggtcttactcagccactttccactacctttcaacctaaaagccaagaaaagcaaggatttggattttaaagctgtacttgttataggtgttcatgggttttgttagcattgttgttttttagggatgaggggtgttactggagtggaagggggagctgtgttgcttttagtttgtcatttaggatgttaaagttagtatgggtttcagtttgcattttaaaaattagaatggtaatgagcaaggtgccagaaggaaataacaaagcacattttcctgaatagctccccctgtcttctgtgttcagattctactctgacttcccaacccggcttcctctcccgcctgctcccttctgaggtgcagtgtagaagttcattctcaggtttctctcagtttgcaggacgagatgctgccggccaggccaagggcagttatgccagctcagtgtagtgcagcttccttgccccagcgtgcgcaggctgaaagctcagccagtttctctttctgaggctgcttcacgtcttctcagggatttccaaggcacggacgttcatttgcctaaaactctcttaaactgcctgacaaaaaaaataagtacctaagtacgacataagtggtacacccacgcaggataattaggattgatgtgctcttttagaggcaccagatcctcaacctccccttactagtggcatttctcacctgctcatgtggtgcccacctgtggcttgctggcattgccactgcctgcgagtggggagatttccaagttcaaaatgaaggcctgattttacatggtggaacgctgtaggactgtgtggagctctgtgaaggaattaaggatggcatgaagtcctagtttatgtcactgctcccttgtttatgttctttccttgactattcccacgccccctctccagattttgcatggcttttatagcctctagtaattatatcagcagcatggagtctatttttatctcttctgaatgtgtgcaacgtaaatgtcaaaaaccataaaggccctttttagcatgtaccttgcatgcacagtttgaaaagtgtgatgcagcgttcagagagatgttgcattttgaggtgagacagatgaaaagtggaaaactcaatttcaccacttagctgcgtgaactttcagtaagtcctttatcatcttgaacgtttagcattttcttctgtaaaatggagtccggctgcctacctcatagggtggcagcatggaacctagtttagtgtctgggatgccccctttccacagcaggtgcccccaaactcctaaattatatatttcatgcttaaatgtcatgacctttcaatgccctgcattgccctttatccaacttagaaacggagtaaaaataaaatcttaccactgtaagtcacaataggattgtcacaaaattagcatgtgaaagaatgatacggaactcactgtcaccaaaaaactgtccctagacttggctaataattataataatacctagcatttattactaagcactttctgggagctggtctctaggtgctttacatgtaaccttcacaaccatccactgacccagtggatagatattcttgtcctccacttaataaaggaggacatggaggcaggttagataacttaacaaaagtcacaagttaggaagttagtcagctggattcaaattgaagcatcctgatcccagaacctacagaaatataaaatgtctatcaggcaggagcattcacatggctgagctgccccagcttctaggcaaggttgtttcctctctttgcacttcctatttgaagttgggccctgaaagcggctagatgggcccgtcagaagggcatgcgaagctgcagtcccttactcagctacgagttagggaccatcatgcttcaaaggggaaatggcctcagcatgtttaggtagtccagtaccatggtacagtttttatggctcattaatttatctttaattgaagataagttgggagaatttagagttgtgagaaaatgtgttgttttctagtcaaaaattctcctgtagttgtgatgaatggacaagatgggagtaactgggggatgtggtaagggataataataaataataaagagcatatttgtaggccctcaacaaaatctagtgatggaaggaagaacatatataggcatgttagacatatgagaaatatcataatacattttatgggtaagctaagaagaaccagttatgcaaattttctctacttttttatgaactacttattgattaccccagtcatttttccattgctaccactgcataaagcagaggaagccagtgcagtcagaaccctcttatttatacagtaaaggctattaccgaccaagtacttagcagccagagaaatcttgcgtgtaaaacagaactgggatctgaagaacttagaatatgtcatttaaagaaatatgatcactggtatgtactaaagtgctccaactttttaaaaactttaaaatcagttgactgaaatttacagttattaaacttaattcttttttttttttttttttgaaacagtgtctcactctgtcacccaggctggagtgccgtggcgcgatctcagctcactgcaacctccatctcttgggttcaagcaattctcccacctcagcctccccagtagttgggactacaggtgcaggccaccatgcccggctaatttttgtaatttttggtagagatggggtttcaccatgttggccaggctggtctcgaactcctgacctcaggtaatccgcctgcctcagcctcccaaagtgctgggattacaggtgtgagccaccgcgtccagccaattgttagtctttggtacggtgcccatgagtcatcaaactcatatgtggaagtttttgaaagaagaaaaaaaaatgagagtagattgattaatgactattaaaaatagcctgggatctacgaatacccatagtaaagagcaccaggcactggatagataattggtctaaagagcctggaccttgctgaagataatatatacatgtaacatgttttgtgaaaatggagtcctgaagatgaaaggtgtatcttttccatattgactacgtgacttaattgctcacttactaggctgagaaaggggagcagaggggatgtggagagggaagaaggagggaaggaaggaaagaaggaaggaaggatagagggaggaagcaaggaagggagggagaaaagaagggaggaaggaaggatgtggaaggacggaaagaggggaaaggatgattcaatatcctttgactactaacatatggcctatttggggaagtagacgatggtgcatggagtctcctgaaagcatcatatgaatgtttgaaaatgttattgcccacacagtgcaagtgcatttaggtatgttttaagataggtgggctaactctgaactagggattcccaagtttaactgccttatgaaggttagaatttgagcacttaagttcagggaaggaaggaaggaagggggagagagaagaagggagacggcactgcaggtagagtatccccacatgtcttacctcttctgaaaggctgatgcaacaaatgcgactgaaaagccaaagtatggatacgttttcaatttatttctaaagagttcaatttaataactgtctgagactgaaaccattgacacagcagagcttctagtaattataattctgagattccccaaagtggaaagtcctaggaatactgcctgaaatgacagtgcatttgctgttcaggtaaaattctttaggaattttctctgattctgatttctatttctaaaattttcgatcatcttcaccattttcccccaaaaaatgaggggtgcatttctgtcattttgtgtgtggttgggtggtattgttgcgtctcagttaggggttgtgaaatggaagctctggagggaggaaaggcattcttggtttgcaactgagagcaaaaggtaccacctaagcatcttctgtgagactagggtgcttcctttagataaatgtgtatctgtaatcagcttaactaagcaggtaaggtgttcattagctaggcagggttttcaaagagagagagagggagagtgagaggaagagagagagaatgaatgtggaagagtgagaagaacaaacaagtcaaagcatttgttcatgctgcaatctacacatcaattatcccgctgtgctaattaccacctttccataccccaggtacctaagcattcacacttactcactttcatgcctctgatcaaaaaaaaaaaaaaaaaaaaaagaggaggaaagaaatgatagaagcaggggatgatgaacccagaggagaaatacattcttagatcaaaatttcctttacatatgaaagtataaataaggggtcttctccatcttgccattgttgttttagacaattaaatatttgcaaatgttttaattgcaaaatattacttactgtcaggcttccaggagtgcttccatctcatcagcccttgtttccatacttaaaagaacacagagaggtgagaattgctggtcttgcctgagattttggggttgtgccattagaatgagatcagatcattaaaagtcagtgactactaattatcaggctacttttctgaggctattcaagaattgggcagtgaggagccagagagctacctttgtatcaaaaccttggtgttccccctcaccgactgaaccttcatctaacaattaaacattctttattatgatgaaatctgggcttggaatccctgttggtttgtgggcttccttgtcagggtgctcattttctcatttcagagtgaagttggataaaaagaaaacctatttcctgtagctcatttgatacctggtggggatgctattcaggtgacaaggatacaggcacagagggggaacagatgtgatttacacactcattatcatttgaatgaaagtgcagataggcctgttcaggggcctgggcatcacctggacagctttccttctgatctttatcccatctgagaggccaggtccccctgacatctttaaatccccgacccccagctggtgacacacagagttttatgacagtcagcagtcctctgaagctccaagcacagatgccattcagaattgtgcttcacactgtttttttcattgtgttcaggcttaatcaggaatatatccaaaaaaagcttaacttgaataatttcttttggtacttctccagaaacctgtttgccactcgaagtttgtgtatagtattctaaagggcctcagattttgtgttcttaaagttatgtgcatacgtagctgcttcagctttcgaaaaaggacaacaaaatggaaaggaccataagttatagatgtcatcaaagtcttatgtttctacgactatcagatcagatgagcttagtattgtggtagatgcagtcagaatgttagagtgcaaagacaatagaaagtttggatgaagctaccaaaaagaaaagtttctgtttggcctcttttgctcttcataaaggattttcagcgtctttgttttgctacctggaatggctgctgtcaccatgatctctcaagcattttgttacttatttgtgggatgtgtgaataacatggaaaaattgctatgtcatctgaagacctcaaatgatgagtcctgaacagtacaaactgtttttttttttttaaatacattttcaagaaagcttgctttcgttcaggacaagaatgcacaacaaccttgaataactttgtttttaaccttcccttatctcaggcagcctgacagttttggtggggagcgaaaagtgaaaggaatctgtgagaacaaatactgtggtgtttcatgattttaattaggtattgtattaaagagaaaaatataatgaacacaagcacatacacattttatttcccatctaacattaacagttaaagaaaacaatcactatcaaattactttgttacagtccataattacaactcaggttacgcttaactgttattaacagaatgtacagtaatatgttctggcatcgtaatatgttattgtagcattataattaatcttacaggaagtataataaatttacagtatcagattgaagcaatactgcatatagatttattaatgcttttaatcagttctggcaaaattaattttgcactgattgcttacattggaatttgcatatacttagtgaaagtaatttattttttatggattcctttttattaaaatagggcatatggccctttagctaaaaaactttgtggattctttagctaaaaacatttctaaacattttgaaatgccatatatcttccctttaagataattctttctcttaagatttatttttaaattatattctttaaaatacttttttaactcttatttcaatgatctattttttgaaactgtaatatttatttccctattgtcattagcctacttttccccaaggatctaagtttgaataaaaacacaggccttgaaaaatatctacattgataagggactgcattaacatttcagaaagtgtcatgtgaaaattaaatatcattgaaaaataatgaaattttactctttgaaaagtccagtaaaaatgggacagcacatgagaattttgccattatttctaagtgcaactatgttacaatactccaaaatgctttctgtgccacgcaatgtatgtgcagaaaaaaggcgagtgcagattttttaaaaaaacttaaactgatatcagtgttgtaagttcaaaaatagtattgagaaaaatatacctaaagtgtctttctattaaaatatacatgctttgtaaggaaaggtaaattattcaccaaaaaaaatcaagatgtcttcataaaatatatgtttactatatcttaacttgtcaggcaatttgaaattttgaataaactcatcacttaaatctttattttacctctttcaaaaatagtaaattaggtgttcctgtaggtattgattaatttattttgcaaaaaatatttgaagaataagggaagagtgatttcttattcttataagtcttaacaataaatatgttccttggcttgaaaattgagtgagcctaacagtacatagctttcttttcctatgttagtgagttacattatgtaaagcatattcatgaacttatatagattctgggtagttctgatgatatgaaactaaattttttaaataatttaactgaatattttgatattgcttgtatcaggaatttcttcactaaaagagcatatatgcaacagtgtgacctctttgggctcaatacaaaagtgatttgtacagtgattctgtgattttccaccataataaattgagaaaggcaggtcttggtaaaactttatagtcatgtatgaatacccatattcaggtcttcacctccaagagacattcattttaatttatgtcgttgtttatcatcaaggaagattttgaacttttgagaattggcctttatctgtcctaaacctctaacattccactgtatcttaatgaaacggaggttctgttctttctgcccagggcttctgataagtgtttgcagactatgtaaacttctgaataataactttcagtaaggcaggagtcttaaacctcttagtatcattttgtgcagtattattctgctctgtaagataatgtgttatcaatacttcataagataactttggccagagaatgaataaaatttatagtcactttcaaactgctccctttttttagggtgtgggtcatagatcatgcagctgtctgccaacagataatcttgatgagtaaaaagaagctaacagagaaaaaggtggcttagtctaaaacacttaggaaggacttaaaaaattatttcccaaagaattagggagtaaaaaaattgtaagtacatttgtttacagtaaaagagtggtctctttgtttgaggaattttccttgccacctcagaaagtgaaaatttactccttttttttttttttttttagaaaattaatgctggtgtgattgtttaacttgtgtaacctgttccttgaggtaaaatgaggaagaagcatatgatttggcctctcttttcagtgaaggaaggaagtccatggaaattactgaaccaaactagagatctaaagcaaaagcccttttgtgacacagatgaactcaatagtgcactgtgactatctgacttttgccacgtccaggcttaggccgccaagcggccagggtcagcaaattccactacctgaaaatgacagaaggcggcagggaaggggaattgaggcatggggagaagcagttgaagcatactagggaggcatgaggttctctctctctctctctctctctctctctctctctctctctctcgtgcagctaaaggaagagaaggaaggaaaagagggtgatcattgaacgactttaggggcaagtctggagttaggcgctgtggtgtccaagcagagccgtgtctggtggcggcaaactagattgctccaagcatggagcgccctgcttgaggacacttgttgttggactgtttgtttacatgcagtttgggtggcaaaaaaaggggaaagtctgggtgacatcagctgcaagaagacttaaccatatgccatgtcatccaacccccaattatttgaacattctgaaggttaagacatcaatccatccatttttctttctcttactctgaatcgtgacattattttctctagttcattgaccttgttggcaatttacaccaccaatataagcctcaggatccttttgtaaaatgagacttgacactaaattagtcaactaaaaatttaaagggtaaagggtccccccagccacccactcctgcccctccctgtactaaagtagaaaatttggacaaggcacaccatgcgtgtgactcaattgttctggccaaaaaatgggatgaataattttatttcatagatgcttggtgattactggactttacaaaagttaaccactagttaaaaaaaaaaaaaaaaaaaaaaaaaaatatatatatatatatatatatatatatatactgcttttgggtactgaggttgaacaattggtcggggataattccataaaatggatttaagtatttaacaaataatgtaaatgtatagagcaggcctaaaatttctccactgcctttgagtatacctttagaagtttacaaatacatgaggataaagcagtttcaataaaatgatcaattgtacaaagtatagaaatataccaagcgtctcttaagtaaatgattacaacatttagaagtattcatgagtttgacatatgcaaagcagcctatctctcatgagtctgagttccagcctccctgaacctttgtgcatttcataggctggtgaacagcccaaacatgtaaataaatagccattcaaagtgcaagcatttttaaaagtttaaaactccacacaagttcttttacaaaagagtccacccttttatgtacctttaaaaacatttagccactttattcttttgtgtctttgaagagaaaaaaaattaataaagttgtaggatccttttgaatttagaaaatgttggcaatgttggaaagaaagacattcagcatttcaaagttctggtggggaaggaaaaaaaagattctgaataaaacaattttatgtgattttgcaggtggtttgagctatcattttatatgtacgtttgtaccactgctcattggaatgttcatataatactgacctaattatgcatagaaaaagataagccatttacttgattcatttcttctttttaaatcaagaaaggaacaaaaaggctcctattttctgaaagaaattgttcgcttttattgcagaaaagtagcagcttgtgcagagctagaactgtaacaattttatattccaaaggttttgtgtgtattcggttagttacagtaattatacccaataactgacagccaaaatcacgtaggagaaagcaaaggctgttttctcacacaggccctgctgcagaacatctgctgagagatttgcatattaattaacccatattaactctaattattctgggaaattatcaaataaattgaattttctaattttaacctttcttttacttgacgcgtgtcgaggctgagaggacgcaccaggccgtctcacctgggcaatgagcaaaagatcttttctaccccttttgctcctttagacctggggcagcctggggagcttttgtgtgccttgtgcttttttggcttctgtgcctggtagggtctccatgcatttgttgagagagggaacatgtgtgcttgtgagcacagatggtggatttatacaggggtgaggaaaggtggtacctcagaacagttgagcaaaccttaagtttttttttttttttttttttcttcctcccagcctgttgtttaggcctgagcaaataaatgggagtttaattcaattagagcctggctgtagtcagtgcctcatgacagaaattattcaatatttttcccctcacattgtttggtttacacatcactgactcccttccttttgtactctgtttagagtggccataatgtgttgagcttttgtgtctgccatgtcactgtccctttcaccgttgtctggttttgtcaattgtgaggtgcaatgatgctgttttgaaaacagggtcctagtcagggtgttgctatgtgagtagggtggctgcagttttaaacatactacacagtaaataatgtcattagcccaatagacctgaatctactgctaagccttaagagaaatcctttgggtagggaagtgaactttacatgcctttctcaggtattagatgtagcttaaaactgagatttcaaagataaatctggtcagggcagtatgaagaattggactccattgcatgatcccctttcaggcatttctttggggtaagaggcaagattgactgagattagaattttttgcatgtgatcaagtttgtaacgacccatactttaagccacagcgatcaggagaaagctactgatgaaacctctaccacaagcagatctccagcccccctacttcgagccacatctcttctaaagacctatgactctatttccccctcaatgatttcacttctccccatccactaagatctattaagatgagccacacctcttgctaccttgaaggtaattgttttcctctggaagagctgttctttcccattatttcagctgatggagtagaagcattacggtacctccatgtaacattccttagactcaagaattattattgacttcagtaaactgcagaaaaccaagaaagtcaccaaataggtctgttggatggacaaatatttgaaagcaattatttttatggataggctagaactccagtctcctttttcatggaagcatggaatgccttttgcaagaaaaatatttctttaagagacaagctgttgctacttcagatgaaggtatgggttcatgctaaggtttttgaggggaggtggtttaatttcgtgggactacaatagctaaaagtgtatttcagttatatctgtatcttagaaaaatgtacagttacagacaaggtttagggtggggcaactaaaacaatcagagaaaatttttatagtttttctatttcgtgtttattttttacagcacattccaacgtactctggcagttactgactttacaccttttatgggctttgaaagttgtgtaaccttttcagaggaaggtgatagacacaatatctatttacacaaggacacatttcccctttctttatattccgtttattcaaggttttatttccaaggtcttattactataaaacttaaagctagacaaggtctgccctcatgtcagataaaaaaaaataccaaaacaattttgatggctcagaagcttattttttcatacttccaggtcctaaataaattacagttattttcacattcctcttgaatatccttcaggcatgatagtgagcatattttttctgtaaagccccttaatactttccttctgatggtttgtatagagcaagttgttgaatgatcgtggattccaataattagagagagtcttctaaaatctttttttccttttgacatattgttggaagacatatagtcacttgatgtatttatgaaagtctgtggaattattggcagtagatgtacaatatatatgaaattatttgtgtatagcagttgttttgggggtcttccctcagcatgccatcatgctaggcttgctgatgaaggtgctgttagactttttagccatcaaagggcattattgacttgtgttctggaatatagctaagtattatgtccttggattgtaagcatattatagatgttgacagaaagtgaagctgaaaaaatttctaaaggatagaaataactacaaaaactcactaaatgaaaggagcggtcaggggcctgtatgtttgaaacatcaatacaatgactagtttcctttggtaggagttaagtaaggtaatcaaaaccattatgagtcctagatatacaggaaaacccgaatatgtttacttttgtaaaaaaataaacagatgtcaagtctttgggaaatcataaatttcactgagaacactgtgacctagaaataccgtgtcttcttgaaagaaagtgaatttactgttacaaattcttcgaccaatatctgtttttaggatagcttgacaaagggagggtccttgcttttattcttatttgccattatgtttatatttttgatattaaggaagaggtttggaggggaaaattacatatctaagatgttattacctgcatgttggagcctatccagaacctcaacaaatgtatggaaatttgaacctttttgaaaatcaccagcatactgaaatttgaaaacctctcccaggtaccagggaacctgctaatatttccagagggaatgagtggctgccatcttcccaagatgctcctgtaaccaggaagttggaggagcctcagaactggcctctctccactgcaaccatggcattgcagaaattctgctctcattttatttaatatgcgtatttttttacatagctaatctgaaatggaaacatttttatccctatactgagaactgcttttgttttatcagctgacattttacaactcattaatttataatgcaggtttaatgccttcgaatgttcctgggataaaaaattaaagtggccaagctagtttgtataaaggctgactatagtatgttaacaataattatttataacaatattttgtattggatagcacattccatctgaatatttcaaattggcatggtcccttctaactggcattaattcattcatcttgcatccccaagtaataaagttattcccatttttaaatggagaaatcaagattcatgcatttcagtgacagatgttcaaattcagaagaaaatctctgtttgagtttgtctttgccttgtaatacgtatttgtcactaggcctccattattaaataagaaattgaaccttgcatttagtcctatgatctttacccacccaagcacggaggtaacaaggtaactgtgatttaaaaaaaaaaaaaaagtcaatgataaatccccccggatgggcaagagtcactggacaaaaattattgaaaaatagctgcatcctctcctcagtagcacatacttggaaattgaaattttgtggggaagacaaggaggaataaaggctaaggttcaggagaaaagtcttagaaggtcttcccgacacttgccacatgtaaagacgttgtaagaaagcaggcccacaaggcctttaatccactggctcaaacataaatgatctctaagcatgtaagcataagagatttaggaaaccaaatgattcataaaattccaaaacacttcttttttttttttttttttaaagacagggtctcattctgttgcccaggctggagtgcagtggtgtgatcatagctcactacagcctcgacctcccaaactcaaacaatcctcctacctcaacctcctgagtgactgggactattggcatgcaacaccatacctgactgattttttatttcttgtagagatggggtcttgcccaggctgatcacaaactcctgacctcaagaaattctccctgcttggcctcccaaagtgttgggattacaggtgtgagccaccatacctggccaaaaggacttattttaaatttgaagtcatattaccagcagagacatttttaaaatgaagttacatgtctgtgtcacgtctaagctgaaggattaggcatggtctctctcatcatggccttcctacttgaggaagcatttgcaaataaatttctaagtgaagggccaacacaaaaattgtgactggcacaagttcaaatcttcctttttcctcgtagccaccacacattgcagcaccagagaaaagacaacagacactgaaacaatggtatttcagtgattataccagttacatcaccttgcatttccatgttactgttttatacatcacacagtgccattgcacatacaactttgtaggctcctatgacaacctcataaacagggaaccattatcatgatttttactcatttctaccaagcttccttggatgataggccaaggccacacagctggttacacgttggttctgggacaaggcaagtcttcaagctcataattctgtgaactgcctctttatctctattgtttccaaactattgcaggaaacatgggtgtattgttagattctggtaattgatcaaattggtaggcttctataactcaaattaaggggatccatgaaagtaacaatcatcaaaacaatttaaaattaagcaacaatctccatttttgtggcatgaaaatcccaaaaagtcccagggatttccatcccttactctggtcatgtggggtttaaacttagattgcattctgcactgggaatttgtattatcatgtatgtttttgtttggctgttgtacacctaaagacatgctttctggtaccggctttgctaccaactagctgtacggcctttgacaagccatttgacctcactgtgcctgtattacctcctttgtcaaagagttgacttcaagtgtccttctggaactacaattttgtgattatatttctccaaataaattgtaagcttcctgaggtgagaatggcacttccttctatcttctggatttgccacattgtgggtatttaataaatgtttgatgatggcattgaacgatttattggcacgcttgagtagagttataggaaatcattattggctgccttattaacaattagctgtctataagctgcatatgtaattttcctttacatcaatagagtttctgcttctggtgaagacgaagtattgccccttcacatcagttcttctgtatgttaatacattagcaactgatatcttatttgtactgtaactgacagaataatgtagagaaagcatataagtaggaaaaggggttagtaaggtaacattgtatagggcatcttcaaaacaacagttctgctatttcaaatgtcaagctaattatcagcaatgtttaaatgctatgataggccatttttgcaaatgctgaaattttccagcaggtatggacgttataaaaatgtcaaattttgctactattctattacatgtcaccagaacacaaaaatctgaaaataaaagttatatgtataggcaaggaagagaaaccattatttgttttgcatatgactgtaaaattaattggcatagtgatataatttagagtattgtttacttggaaggaagagtagagaggatttaatataatgtaatctggtgaagtgaaaataatgcttattatagataaactataaagccttttaaatataggcttttagtaatgcatatgcagatatatctttccaggcccatttgctataaagcaaatttaagtatcagctttatgccctttggtaaccccatattatacatacagttttagagaaaatgaaactttaatatgattccacataaaatggtgagccatgccagtaattcttatgcccttcatatgcaaatagttttatcttatccatcaattatcatgtaaacatagtatcacatggcaaatttccctgtaatacagtacagtacctgtatataattataggtgcattttgccaatgcaactgttacacagaattgtaattaattcctctgaagactactgtgagagttttggatactgatgctgtttttggacatttattactgctctttagttggctttttgctatgcctcagagacagatgtaaaattagtgtctattttgagccagcaaacagtacatctttcctcttgtttattgaattgcagaaaggaattctttgggctcccacttctttgtggttttgaagtaactgtctgtttttgtgccagccatgtagctccaatacatgtctaaaattttgctgagactcatgcaaagggtggcttatttgacctgtaaggactgaatagaactttgctacgttatatgggaacttccaggcttttaaatgctgaataaaaagatatatatcataagttcaaaaacagacactggcctaatatattctgcccaatgaacctcatttaaaaccagtatacgttggttattatacaaaattgaatctcttctttgcagagacaaagctacattattaagatctcttctgccagtggtgatgatggtgggcaaacatcaaaacaggtccaaatgggaaaatgagcttatttttatttcataatgtaagtgcggctaaacccatcaagtattggccattctagagtaagaatattttatggtgaaaatttccacagtacttgtactaggcaaatccactgactagacgtgagggaacattttaaaggaaaatcctgggatttagaagtcggggcatggggtagggatcaggaagtgcaaagtccatctcagtgcatttaattttgattgtcagatggtcaaccagaaagagcagaatgagattgtctcatttgaattcagatataaaaactatgttatgaattgttgtacctggatttaaaaaggggttgggagagtggcacaccagcataatggcatatggaaatgcatatcctagttaacacagcgctagaaaagatggcatactgcctctgtaagtgaatttgacagcagttatttatttagtttaaaagtatttactactatttgtgagcacaaaccctaaaggttgtgaagtattgttgtcctgtgaaggtgatggatgctgtactcctgaccctatatggtgagacatgacttcattgcttgtttagattgttctgatatttgggactcctcaagggctgttcataaatcatttatctctcttttttttccacaagaaaatatttcaattgtattgctgcaggaacactcacgtgtcacacgggatattgtggtccatgcagaaaaagaccttaaaaggcatgggtttttttttttttttttccaggataaaggccttttaatgcctgtccagccttagataattttattcactccttctggacctttctttattcctcctgtgcccagagatcagtttttaggaggtgggttgaaagcttcccaggccttaggagcttttgttgtagcccccccattcccactcccccctacccccagcattctgaaaatttgtaaagaatcttctgcttgttgctaagaaatagttaaatctcagtcaccaggaaaaaaaaaaagaagcacattattgattgtactaaggtatatctggaccacacagctagagcagagatgttagaatatctctctttttgtagatctgagggcattacccagcctgaacttgcctaagcccttgtggtcacacctcttgaaaaggttttgtttcccccgtcaattggtattcaaaccaggtcagcagattctgtttgcccggctccgctgccgttttcattttaatttgcacctgttgtgcagttgttcggaaggcaagtgcagacccgcggattatacaaagatcatattatgagcagatatgcacggtgtaatctttttgtccccagcttcacatgacaaaaaaaaaaaatctctctctttttgttccttttttactccctgggaacctgtcaaagcaaacagatatgactgactaaaatttgtaactagacatgtttccagaattctccaaaagcattatgaacctgacacacaatccttttcatttttttcctccttttctgccacttttgtataatccgatagctggcaagagccacttgagatagctcagttgataacttagcggaggattgctttattaggcgcagagaaatcaaaatgaacctgaaaattgtttgcgctttttttttccacagccttttttccccctttctctctccctcttgttcccatgatgtcatggttctaacttgtttttttgtgtgtgtttctggagagttgggttaacagttcttggcaatcctgtgtgtgcgtaacggctggtgtgtttctctagctgagctaatgccccgtgtttattactctaatctttcttgtctggtggtaaagtggacaatttatgtactagcatgtaggccgagagcctgtgagggctgactaattcagaaacagccaccttcaattgagttcacagaccttatttacaggctgtctattttaagaaaagctactgagcattgctgggactgagggctgcaaaagcagcccgccggttcttgtgagttattttaacatttgtgttggtcttgcctgtgtcactttgaaatcttctgtaattatgacactatgaagacatctcaatagtagtattaatggcccagaagatatggcttttcctcattttctgcttaaaagattaggatataaatggccttagcacatgacggttgacatagaagaaagagtgaaaattcagatggagcaggtttgtgtatgtgtttgtgtatttgggtaaatagatggacgtgtgtgtgtgtgtctactgtttctagggaaaaaaccacagttaatatagtgaagtcatctcgtatttatagtacaacattatatagtaaatacttcatgtctctaagctaataaaattgtctattgtagatctattttataagtttttgtggagtatcgaaagtacatattgcaatacgtctctttacatatgcagtataggcatagtttgtgtgtctatgtttctgttgctttttagaatttcccatcatttttaggaaaaaattgtttaaaatcagaaagagcacccagctataattgaaaaagaataaaaatgctaaaacctgaaggatattaattatattttcctgacatggttgagtaattcagttatgaaaatattaattattttccatttaactaaacaattaggggtggctgatgtttctcaacagagtgtttagagagtgtgttttgtgcttcttctgcagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccaggtaagtgtctaaaatcacttggcctcttcctgtaccatcttcacatcttcaactaatctgttccacctagcagatcgcccacaaccaaataattaaaatatttctttccattgagcccttgcagaatagagataccaaagctggtgacagattatgaagtgatagtaatgttatcacattgcggcagttacatcttaggaagggattatatttcagttttgatgcaagtcaaacatgaaccacactttcaacacataacatgaggtatttgcaccacatttacaatgtgcaaattatgtaacatgatcaagatctatactttcatgataggaaatggaagcaaatgtaaaaactcacaacatatatatgtatataaaaatattttgtgtggaaattatgtagcatttcaaaccaaataactgtcagtttaatgtagcttcagtgtctgtctgacacctcctattggaattcaatcgtttaatgattcccttttgttaagtgtgaatgtgatttcacacttttacctggtcaggtagctttcttattatttatcagctaagtacttgataatgattcctgctgtttggtgggactctcaagggaagtaaaaatggtcccaggccaactataataaaactaaggtaaattatattcaaactaaaacttccgacaacactgtgcaaacgggaaatgtcttggtctaaaattcacttatgacggagaatcgctaaggtatgaaatgtttaacaaaatacaagaaatcttattcctgtgaactttctctgctcatctttacatggtaaagtggcctggaaaatttgtttaaatgacctctctaattcagacctcatgtcaccttcatctctattcccaggacccactgagagttatcattgtttaccccaccttgttttttctttgacaacataagcaacaaaagcatttttataaataggtgaagtggctgggaaggagtctacctatatgctgttgtgatgtcgcagactataaaccatcaaacataggcagaataattgtttggtatactggaaggaggataataaaagcacttccactacgaaagaaaattaaatgtgagatgaaagaaaaagaaaaaagactgatggcaatttgagtacagtgtatttgtttttcgttttcctaacatactgtgccaagttttctactctttccgtttccaattttgctttcggtgaaggtttctcgaatctcagcaatcccacacataaacatttatcgttatatccattaagccttaaggttttagattttcaactatgagggagaactcagccaaagatgcttgaaagataaatacgtttaattaggggcagaggatgatcattaaaggaagtctgactgctgcagaagtcattaacaatcttaaatgaaatttttatttttatgatagccatttacatgtataataagagccaatgattcttgggagcagtgtgacagaaacagagtgtggcgagaactcatgtaagacatactatttaaatgagctggtgttagctattcatatttgttaatgaactagatatgcagggctataagaatgaatgttctgatgctttaaattttaatatctagaaatcaagggtaaggaccaattactagaatttccacccttagaagaataattaataacaatgtaacaaatgtacagccccaaacctcttttaaaaaagtttaatttaaaaaatttaatatcaatagttgaaaaacagccaaacagcaatgtcaagctgtagtagtttgtgattgtggcagctttttgtgttggtcatggatcataattctaaacgttttaatatacagtaatccatatgaatgcattgcagaccctgttatcacctgtagttaatggtgcctgtgatacaagtgaacaggctgttctttgctcttacctttatggtaaataaaccagcattctggagtcacaataattaaataaaatgtaaatccctaatctcatttggctatttggaccaagaaacttacccggctattacctgtctagttctaatgattactaatgatttattgttctttttttttattgttctaaaagtgctctgatgtggtgccttgatgtctaatgaaaagaaattggtcttaaaaagctactcattgtttatcctgactctgagataacacatttttcttctgataaaatatttttcttatttattgttcaaaacacacaatatagacaataactctaattctggtgcagttttatttagtagtgttttatccccggtgcctggctgtctacagtcatacctcagcacatagctttactctgagataagccctctctcctttgctctttctcccatgctttctggagtttgtctgcaggatgcaggttttgaactgaagagcgcagtggagttcttactgtgcctttccggttccagcacaatcaaagttttgtgtttggaattgtccttgacattctttcgtcccacaatggggtggacacagtgtgctggaaaccatgacatcattatcattgacacagacttaaataaatcacctgcatcttggcctctttctgcttattcaaggattcttcatcttaaggaagaaagtgctctttatttttacaaatcttcatcccaggggtgactggaagacgcaaacttttacaagtgttttaaaaataaatatactatgtggttttagacacagtatgctgagtcagaggtgtcttagagaatgtttaaggttagacataaggcagaaagacagccagattgcctttaattcggaggcaatattcctaaactgtgtatcattatgtccttctgaatatggattcacttgaaacttaattaaataggcatatacataacatttcaaatacatacctgaaaaggcttagtagtgtttcattttcacacattgagcttgatattcaaaaaagaaaaagattgatgctcagtgaatcaaagcaaagtactttctaggtaaaagtgacaccatctcatccaatgtctctgaaagatctcagttgcacagtctttggataaaaagggttataactaaataatactacaaaatgcaatttacacaatgtgctgactacacatttgtatacccagcatttattaatttgggaagcaaccaactactgtaacttctctttactttttcataagaaaatgacaatgaggaaggaagtgcagcagaaatcttgaacattaccactattatgcaaaaaaaaaaaaaatgctgttaactgttttcccctcagtgacttgatgtgctctcagatggaaaacttatgattcttgtgactcttggctacccgaaatcacatgagatgagcaaggaagaaagacacaaaagctatatttatatctagccctgaacttctcagaaataccttaatatgattccttgcagagactgataaaaatatcagatgagggagactttcaaatgatcaatgattacaattgacaatacaatattgctatatattaaacttctaaatgtttaatgtaaaatgtctctctgaaaatattttttaaataaaggaaaattccttgctcaggaatgaatttaagtggttgtacagcttaaacaaatatcattcaaattatctgattattatgaggagtgagattaaattagcatccaggtatatctgtgtattttaccttaagaggatcatgatttttcagttctgattccataaagagatttgctgcactgcttgtaaaatatattttattttatttttgctgtaacattttctagaacctgttctttcatgaaagtagattagaatatgataagcaaagaatgaccaggacagatttggaaattcgtagagtcctagttacaaagtttcccttgttttaagtaaaatgattatcacagagagatattcatcctggagcatatttggtctcattagtattgtcatagtaaaaataaaaatttttaaacttcacgtttaatttacttaagagatttttaactatcagctatcctgctctgtcctcctacgtcctctacaatctggtaggcagaaaatttgagagtgcccctatttttcaaattctcccttattttaaaatattgcagtttttgacaatgacctttaattgtttatgaatttttaacttcaacattatatatattcaccttcatcagaacactgagctgttgttatatatgtttccccagaaaatgattatgattacctacaggggcataaatcatgatgaggacaagacatttatggagtagttgggataggaataaggcaggtacgttttagaagtttgtatcaagcagtgaaacaggtattgttgttacttctgggatatttgttgtacaaactgggcattccaagttttgatatgtagaattaggttttcaaaaagtatgcttgcatagattagcaccattatagccaccccaaggggaaagaaaagcatgaaaacaaaatgtgaaattctgacttgccactaagcatccagagtttccagaggcatagcagccagcatgcctcttcatgagtgcaaatacttagttgcttttgactcttattgaaaaaataatatctttcccccatttgtcactagaactgccaccagaagaaaagcccttcatttgctccaaataagcacttctgtttttcacagcttgcagtaatgcttaaagtaaataagttcttgtgcagctagcactattggattcattcaattgcctgaacaaagctattgtttagaggtctacaacaagccttttctctgtttcctttaaaagaatcttccttgttcctgtgcttggcatgcttagtatagtaagcctttctacaattctcaaatgctaaagataattttcccccacagaagaaatgaaggaagactatgacactatggggccagaagccacgatccagaccgcaattaacaatggtacaggtgagttatgttggccacgctcagatcacatttgtcctgtgtcatgtgggtttagtgaggcagggaaggaaacagtgacacatccatttgtatctccatgacttaacaagtagtcaactttacaggtctctggttttgtttcaaatcaaaatttcctacattttggtattttactaagcaaatacatctttcattctcacacccctaatttacctgtgacgctcaagaatactgaactctatgaatggatcctttcagtgcatgagttgggtgaatttctagtagtaacttttattttaaaagactgcaaaaaattattttaaaattaggatatgatatacctctgctagccaccacttgatatcagtcgttgagaattcaaatgataaggtgtaatttagactgtaaaatttttttttcagaaagacaaatttccacgaacatttctctcaataattaatcatctcagttccttttaatcctttctttacttgtaattctctgcatccttgagcccttttaaataattttttccaggcagttttagagaagaattgacaagtttacttatttttaatgaagctaaaaaattacagtgggaagatactgagtggtgttttgttttactctgctactgcaatagaatggagtttcaggacaactgtgatattccatgttttttcccaaacactgaatggcatcttctctcacattcttacatcaccaacacaaatttacatgttccatctctcttttcctagatgagactatttattttgtggaggggaggggtgttgcaaacagtcctctacactaccatcacaaatattagcatagtgtccaccataaaattatcttccaaaataaaacaaaaaaaaaatgtaactacttctactcaactcatccatgaaaaataacttgaagttttatgaaatgtaaaaaactaagatgattttacatcacccttatgttgatacacatcatgatagactgctcatgttgtgtttctgtttaaaatgtgcttattaataacttaaaagcatgaattcactttcctgggtataaaataagagaaataataaaaacctattgtcattctattcattcgaataatgtcaatttaaggtataaaaataaagctgtacaatagatgattctagaaaaagtatagaatcaagcaccaagaatcctaatttttacacacagccctgacaatgactagattgtaacccttgggcaagtcagttttcctctttggaactcagttcccacaactgcaaaacgaatagattcaactagtttcttgataataatacttctagttttaatattttatgttgcatgggtattatcaccatgtaaaaatagaaacaagataaaataacttcatattaaaacaaaaataaagcgatatcatgaattagatactttctataatgtcccaactcatgggatcaaaaatggcttcaagttccttttaaagataaatgttaaatttcagcctccagcataaataaaagctgattttgattacccttataagcacttaaagtgtcacaaaagaaaatttaccccacaaagtaacaatttactagctgttgtatacacctagagtttaaagtgaggttaataaaaattgcttctattcagaaggtttaaaaatcaatcttgaatgtcttttcaccaggctttaaacaccccttttttctcataatacctgctgtaccttgtagttcatatgtattcagtcaataaataaatcaataagtgttcattgagtgtgttctatatagtcactgctgtgtgcatatgtggtagaagatgggtcaggaagactaaaacatggttatcatttcatttggaagatgagactaatacacctgaaaaaataatgatgaagaataagtgaaaatatgtgataaacctgcaacaaatggtaggagccataattatttagttttttgttgttttgttttgatttgttttgttttgtttgagacaagagtgtcactttgtcacccaggctggagtgcagtggtgcaatctcggctcactgcaacctctccctcccaggttcaagcgattctcctgcctcagcctccctagtagctgggatttcaggcatgcaccaccatgcccggctaatttttgtatttctagtagagacggggtttcaccatgttggccaggctggtctcgaactcatgacctcaggtgatcctcccacctcggcctcccgaagtgccgggattacaggcatgtgccactgcgcctggcctataattatttgaattacagaagtgagagagagtctatggaatgggcattcacatcaggttttgtgaaggaggtagaattcgaactaaatacattttcaatagtcatggaggagtgaggaagggctttctaattgaagaggagtctgtgagccaagaagggaaagtgtgacatctattcagaggatagtgagtaaagggttttggctgaatcagagagtcctaggaggcaatttctgggaaataaagctggacatttaagttaaagccagatggtggagaatataaagcaccagacagaagagtctgggtcatgttatgctaccatgatttctgtgggtgaaaaccagactctgagagaccaactggaagtcactgtagttatccaggtgtgaagtgataaaaatcttgtcctaaggtggagacagtgatgaaattagcaacatgacttcttaacaaacaattgattctctgaatgatggaggcaaaatggcttcaaaattacagatctgcatgtttagcatatagcagtacttgctatttctagatttacagaagaaggatctaattttgagaagatcttgaaccagcctttagacacaagtattttcatataaaagatatatagatatgggaatataggaatgtcctttggaaatgaggaattgaaacccaagaagtcagggctggagatagagatttgagagttatgcaaatatactcagatcatgttcaagatcacacaggactatgagatttacaactgagtgtatttgttgaagcaagtagaaagctgaggccagggctcctggtgggtggggaggaaaatcaacaaagattttcttttgaaaaaaaaaaaaaaagattatgacacaagagaaaaaaattaaacattcagaagcaaagaaagagaatttcgtaaaggtgagaactcagttaaaagcttcaaataactacccttgaaagaaagctgagcaaatacactggacttagttaattagaaatttactagtgatcttcagcttacaactctgccctttgagagaataagtacatattctttcttcctagctacaagtttaccacttcttctccctgacatctctttggatgctaaatacatgtggttttagaaataatacatcttttctggttgaaattgcatctaaaagactatcttcctctgctcccaagtcttgctcatcaagctcctgctattggctgaatttcttctctagccattccacactagaatgtctccctccaatgagcctgtggggtttgggctgctttatcgccatggatcctggaatggtctccatcacaaagtgtgtctgaagaaatgagcgagtgaatgggagacaaacagcacttggacttcccttttgtattttcaggttaacatatttttgagccctggcctgaagtaaccaaccagacattttcatctctccattattccagtcatccaaacttgaaagccttagttatatttgactgttctctgtccctcatgtcctcctctatttagtcagcccacatctttcctataacagtttcctcaatgtccaaattcccttcttagaatcctgaattgccccttagcacctacaggacgttcttcagtccgataataagtgccatccattgtataccaatggcgctccattcttgtcagaccaaatcccttggtgacaacaaaaaagaaccacatttataccaacctctgaatctctgcccatgctatcccttcagaccctaatcccccagctcctttcttccagtcatccaaattctccccatccttctgttcttcaagtccaggtcacatcccatttccttaatgtggtcatctctgaacaccccaaacgacagcaatctcttcagaacccttgtggggttctgaaatcccacaaccctaaggtgtatgtggctaacttcagcatgtttcatcgttcctccttatattgtttgcccttatttcatgtagtcaatttcatgaagacaagaggtttcttcagctgaaaaatgagggtggatcatcctggtatctacctcattggctgaccttgttctctagccagtaattaaataaataattactgaggtaattaaataaataatgaagccagttgtggtggtctggcccataatctcagctactcaggaggtcgaggctggaggatggcttcagtccaggagttggaggctacagtgagccataatccactgcactccagcctgggtgacagagcaagaccctatctcaaaaatagtaataatcagaatgtatatgtcgatattagtaagtgactaaaaaaatgtttgccctaaggaaaggactattccatttgcctcaacaagcccagttatagcagggagcacacatggcagatattacaactggtgaaatgaatgaatgaatcaatgaatgaatatttggtggagaagaaatggattctgataaaggaagccacagtaggggaaaacattctctgtggaggagactaagtatcttcagagagtgaaactaggatctaagtccctgaaggattttgccttgttaaaggcaaagaagaatagcctagagtatcactacattttttttttaacaacaaagttagattaactgaatggcaaaattgatctataacacataaaacagtgcaaacctggatttatattaataactttccacattgcataagttcaccagtttttatttttttttaaaaaaggaacaaaattgtaatgctttcacacgtaagataaagaatatcttctaacaaagagccttacaactttcagatattaataggatttaaattcaaaatgaaattattaggtaaaatttttaagtgtgtgaatgaaccattttctaagaagagtagagaaatggaaaaacttggaagcattatacacatgagtttgcctacgtgctagtagtaacaaggagctatcttaggtgcatggtgatcattagcattaatgcagttccacgtgcatatcaatatccaaatagggccctgatgttttactctttgaatgtgtgaaagttatatttactcagacaatctagtacctctagttataaagggctattaataaccacctgcatctgcgcttcctttgctaagagggggaagaggtaccttacatccagaaactgggcaaggccaatttaggcatcagttcttaatcttacacaacacaataaatttcttgtctaagaactaactttatagactctaactatagtcaaacttgtttccagtattctaagaataatacataaattatttcacatatgagaggcaattgttttgggaggctccagattctagagaccaattacctacacttgaattttatctctaccaattactagttacattaacttgagtgtgtaattgataagccttcatttctacatcggtaaagtggaaatcatgattccttatgtacaaggcctcgctgtagggattaaatggcatgacatttttatttatttattttttaactttatttttattttctttctttttttatttcaataggttttggggaacaggtgatgtttggttacatgaataagctctttagtagtgatttctgaggttttggcgcacccatcacccaagcagtgtacaccgtgcccaatgtgtagttttttttccctcatcaccctcccaccatttccccaaagtccattgtgtcattctcatggcatgccatttttaaagcacccagtacaacaactaacatagactagatgctcaccctgttttgttttgccagtttttttttttttttgtttgtttgtttttttttgagatggagtctcgctctttttgcccgggctggagtgcaatggtgcaatttcggctcactgcaacctccgcctcctgggttcaagcaattctcctgcctcagcctcctgagtagctgggattacaggcatgcgccaccacgcccggctaatttttgtacttttagtagagatggggttttgtcatgttggccaggctgatcttgaactcctgacctcaggtgtccccccgcctcagcctcccaaagtgctgggattacaggcatgagccaccaggcctggccaacttcaaactatttttgttcattaagaaatgaatacatcgtaaacggttttctccattcatactggttcctccttaactttttctctaggaaacaaaaatacaattttaacaaatttgtaatgaaagaactaaccaattttgagaggctttgacatttaagttcttttgacattctggaaaactacacagacaagttgtaggacacattattttcagtactctggcatttgaggctaaaatatgaaggttaagaactagtttcgttttatatctgatttcatttttatgtagcatcccttctttaactgtgtaggaggaggatttagtagtatttataatgattacgtataataatgatgaaagctgtcagacttttcctttctttgacaactgactcacatcaggaatcgtattctttttaaaaatttattattgacacataacaattttacatattaatattcgtgaggtgcaacatgatgttttgatacatgtataaattaatgatcaaatcaaggtgattagcatatccatctccttaaacatttatcatttctttgtgataaggacattcgagaacccccgttctagctattctgaaatatgcactacatttttgtgagctccagtcacataatagaccaacataactatttctcctatctaactgtagttttgtacccattgagaaatctctcattgttcacccttccccctactctcctcatcttctggaatcagcctaaatgtccatcaacagatgaatggataatgaatggtatatatacccaatggaatactatttagccataaaaaataatgaaatcatgtcatttgcagcaacatggataaacctggaggacattatgctgagtgaaataagccaagcacagaaacataaatatcacttgacctcactcatatgtggaatctaaaaagctgttctcatggaagtggagaaaaatcatatatatttttttcttcttaccctggataacaaccaataaacaaaaacgaagcatttgcccattgttaacaaccactaaaatacatacattcagagtgtttgttgtatgtagaatttgaactgaggcttgaggaaactttaaggaaatagaagggtgagttccttccactaagcaacataaaattttaggggtgttgataaaaaaaaatcataatgacaagaagagaaaatttacaaataaataattatagcctcattagttattcaactcaatggtcacttattgggaccctactaagtgcaaggcattttgttagtcatcacaaaagatacagtgagaaaagaagagtcactgtcattaaggacctacattcatccgggtgaataaaacagtggtagacgaatacgaaatgcatgtaaaatatttagtgcaacgttagcgcataataaatgcgctatcatttctagccattattattgattataatatcatctggattaagacgttttatttgaaatacagcaagctatgtaagttcaaatgcaaagtgttcagtattgtagagggtttctgacagtatagggtcaaatattggagataggacaagagaggtgccttaaagaaattgcaaatttcagggaagactttcttcaagacaaagacttgctgggtatgcctctgtgcacaagagagaaagagagaaaggctgaaatgtaaaaggagactgggtgaaagatggagtgggttatcaaacgagttgtaagagaataattttagatgatagccacaataatgtttattttttagcagtaagatcagaagaagaagacagaatgatgataggagagaatgtagtcaatttaagatgatccaaggaatacacactgtatgggttgcactctttgaagtcaataggaaaaagagactatcagtcagcagtaagggaataggaatacagttggaatcttgagacatggacatgtagaataattgctgtggacaatgcgtggagattcaattattaggaaggaatatcccattttgaaaacatagtctgcaacaagactatactattatttaagatttttttaagatacgtttgatactccagaaattggactggatcgtagttcagcagggtaagaatgatacaagtgtaagggacagagatggaagtgatgatttcaagttccaaggtgaactgaggtaaataaaatcagaatgggtaaaagggactaggaaacttttcagggcctgattgtcacattgaagtacacgtttcaagggaatgagaaactggatgataggcaaggggagaaagtagaaatcagagagcgaaagttcgcggttctggttcttgtcccagggttagcccaggagcaagtgtggccatccatgttgctggattagagaaagcctaagcactgtgaagccaggttctgcatggactatctattaagtgatgaagtttcccagaatgcaatggcatcctgtgggaaatgtaatcatgggacaggcgtcattttgcttgcagtatacaggcaatgtcctaaaacatgacggtgaaaatggatgactttcgacttcgacttcaaaccattacagctacagagtggaaacaatttgagggtagaggttaggtctgctcttctccataatccctctcagaggatgcagtggtttatacagtgttaatggttcataaccagggtatttgttgaattaatgaataaataaacaaagaaataaatgatgagtgagttgacgaaacaggaacattgattggaagcagtagcgtgaattaaggagtttgttgacccttcctctttgttctgtgagtcataacaaatgaaagcaggaatggccctgtggaaaaggtctgtaagggatgggttattatcaggggatgacacagtttcatttagtctgaagaagtggaacacatgtaggaggatataattaagcatgggaggaaaataacgagtaatatgtgaaatgggaaagcaaaatgaaccgggaataaagttcttttttggtttctagtccaaagttaagcttgaggcatttcttgtttactataaccacaaaatatctaatatctgctaactaataactaatacctgctattttaacagatgttaaaataatacctaataaaaattcacctttgcaaggtgctatggaaagttattctttattgagcgcctttagaaacttgattacaaattagaaacagtcaaattaggaaatacaatccttaaatattaaatggaaattttaaataagcatcttgaacagagaatttgaaaaacttttatgtgttctctttgccccactagacccagctctggattacccagttaaaaaaaaaaatgtaagaataaaacaagtgtctaggattcagaggaatggggacatttaaaaaaaaaaaagaaaaaaagtaaaaattttctacacacacatatacaaacacacacacacacacacatacactctgaagtgggcattttaactgacttccccccatattcattgtatggtgtaataatgttgctatttagaattgcttataatgtcattgtgatcgtttcagtatgtagggcctgttcaaatggtaccaagtcaggcatgatgaaaaactaaaaagatgaggttctctcttttcttgcctctttctctcatgttgagtcattatggtgcagtagaaagagcagtgggtgaagagtcaggatacataaatcctacatacagctcttccagaaattacttgtgcaactttgtatgaatcactaacctcactgtaccttagttgtaacatctgttaaatgaggaaatcaggctagaaattttgaactccaccccaccctgccctttcttctaatgaaattttactggaagcatgaacaaaaaaattactggaccgcactagccgtcatgggatgggaggctctcgggggccctgcctcacgataacatacacagggccagcttcctgggtctgggacctgcacagtcgcacagggcccagcactgagaagggctgcttggttggctctgcagttgctgtcttgaagctcttgacaatttttgaatgaggggcccaacattttcattttacactgggccccaccaaccatatagccagtcctgttcatgtctcacaaaatacatgagaagaatagcagagtacaagctaggatgggaagtggtggaatcagagaggcactgcttcaagtattgaacagaaatgccagttaggtctaagtttacaggatccttctttgggtgtctccagagcaattgaaccccaagtaaagatccagatctagactgaaaatcttgcctcagcaagaaatacagtggtgccaggtgtaactcccctaaactgataatattagtataaggttggcagcctagccagcaattaagtctctttaaccatcaattctgtgcatcgcatcgttagcataggggaaagtgggggaaagaagaactttttttactttcactatcctcttggtttaataactctcaatttctcctgttcctcttaacatggagcttaaattaaaacttttaaattagttagctttcttatatcagtaacagaagcgatacaagtttgattataacgtatttctctgcaagagttgagtggatatataatgttaatcaattgtacaaaatcagtttatcagataattcagttagtacctaaatacttaacaaggagggaatcatactattacaaagtatgtcatattcttcttggttgtatctatcacatttttataggttggaagagttttgtctgccagtcagacatctgtcagggaagtcattattttttaatttcttagttaacttcatacattgagtttttaaaaataaggtggagaaagagataggtttggaggagagaaaaatagaagtagtgcttggcaggtgagacgggggatgattttcagactataatcagtgaacgccaagaagagcctgttcacttcctggctaatgaatgctgttgttttattagctttgtttgcgattaggagcagctatcttcacttcacagcaagtgttcccacaagaaataactgatatttcaagcttcttgagtgcctccttcattcattcaacaaatatttaataagcgctgttttgcttgtgatgttgtctggggtttccaggcacttccaaaatattttctcttaatctgcatgtttgttttccccatcagaaagctgtgttgttttgagtttttaattgaaaagaatacagataaaattctctaggcctagccagtaaagaaaaagcaaactgattaaagtaattaattaattgaaattatggaattctggaactttgaggacaccccagaaagcacaccctggctcattttacagatgaggaaattgaaattcaaaaacatgaaataactgagccaaaatgaggagtccaaggaccctgaaccttgcctaatcattcaattattgcataataactgtgacccaggcactatgctaggtgctggtgacacaaagctgaataacatatggttcattcttttatcagctcacagacacgtaagagaaagattacgatgggatgtgatcaattcaatgattgagacacacagatgacattcagtaagtgaagaaggaagtctatgtgaactcaggctgagatagtcaggaaagctacctaataataataatatgggaccaattgtgcttctctccaaaatcatgttatgaatgtctcatttagccatgcgaggcagaggattgaatttgtagagttcttaaattggacaagggtcagaatttcgtgaaagacttgttaaaacacagattgctggttccataggtttggatgggccccaataatttgcatttcaagcaagctcccagatgatacggatgccactgacttttgaaaatcactgactgtcctgagcattcttaggtttcacgtgtctctacataaagcataagaaaagagcattgaattgctgggcaaaatcaccttacttcatcaactcctctaaattataataaactagtctatctttttggtaatatgccaattccaaatttttaggttacacagtaatgtgaaagacaagtgcatattgtctatattgggaatttttctttgtgtgtgtgagatggagtttcactcttgttgcccaggctggagtgcagtggcacgatctcggctcaccgcaacctccgcctcccaggttcaagtgattctcctgcctcagcctccctagtagctgggattataggcatgtgccaccacacccggctaattttgtatttttagtagagatggtgtttctccatgttggtcaggctggtcttgaactcctgacctcaggtgatccgcccacctcggcctcccaaagtgctgggattacaggcgtaagccaccgtgcccggcctatcttgggaatttttaaaaaagtaatggactctatcattctgtgccaatacacagcaatcaaaatcgttgagtgttagcagtctctacatcttgatattcaaaatcccctaatgtaagatctcctgctgtttagggagatatttgatactgcagactactacagattcccattccttgtccactcttcacctcgctctcctgaagctctcttacatgagaaactctcattggcatctgaacatgtgttccctggagaaagccatgttcagagcaggggtggagagagcggccaagatgctgtactaattcccaggaagagcagaaaacttttctgttgctcttgacgacctggctttatccatgcctctgtaccagctggaggctctgcgaggccgcccatgtagctgtgtaatgagaaaaagatcatcctcttccctcacggttgtttttaggtaactagtgccaatatgtcttttggaaaccttctgcaaaaacgcatacatgcacttttaatgatgaaaagcttacatttattaattagtcaactttaaacaaagtagccatgagaatctatagacctcaacaaatgctgaatatgtgcttccttaaactaaaaaactcaatacaaatgactacattcaaaataattttcgtgttttcttatcatctgagatgttaacaaaaaggctgtttttcaaaaagatgataaatacagttacctagatttgtaattgcttcttcaggtccctttgcctttcatagtgaagtaagcaaaagccagattatatgataaatacataatttatgttatatacattacattacactggggaagcgtgtgtgtgtgtgtgtgtgtgtgtgtatatatgagatgccctattatacatatatatatatatatatatatatatatatatatatatatatagacatgtctgtatattgcagaatcacaaccattatgtgtatatatctccaaacgggtgaatcacagaagtaggaaaaaaatttaccactcatgtcctcatttccaagaacactggcactagtaggcactcaataaacagttattaaacaaggggatggatggatgattctactcagttttttacatatacttgctgcaactcctctgtaccttccaagatattttctttttaaaaagaattatttattcattttgatgtttacttaaatggcttaacataatattcaattttcttccattttttatgaaaattaaaagcatgcaggacactaaaccagtgataatagagtacctgtcttccactgtgaacacaggcttgctacaaataaagaaaatgaatgccaaagggaaacagaaaatgataaagaataagtatctggtctatatttcattacctgtaaacactaagcaaagcccacttttaagtatctttgagaaagtattctaaagcaacttgattatgggggctgactaatttggggaccaatatttctcttttatttagagttctgttaacatcgcttgaattttaggcaataatttttaaggccagtctatgttgatatttattattatctgtctgaaaaatcaattatctatctaacgcagccataaagatatctataaaagtgtcattaataagcaacattagtaagagtggccaacatattgccaagagaactgaggctttcctgacaaaaagggacctgaaaattcaccctaacaatctaacagtattaaaatacacatggtcatgaggaaacatttttaattaacattcttttttatggctgggcgcggtggctcacgcctgtaatcccagcactttgggaggccgaggtgggtggatcacgaggtcaggagatcgagaccatcctggctaacggtgaaaccctgtctctactaaaaatacgaaaaattagccgggcgtggtggcaggcacctgtagtcccagctacacaggaggccgaggcaggagaatagtgtgaacctgggagacggagctggcagtgagccgagattgcactactgcactttagcctgggcgacagagcaagactctgtctcaaaaaaaaaaaaaaaacaacaacttttttttggtttttttgagacaggggtctcactttgtcactcaggctggaatgcagtggtgcgatcacagctctctgcagcctcaacctcccaagctcaagcgtttctgctacctctgcctccccagtagcagggaccacaggcacgcaccaccatgccaggctaattcttttactttctatagagacgagatttgttgcccaagctagatattctttttttggatagagaaaaggttatctaaccttagagaagattgagagatatttgcaagacattagggtaaattttaggactaaatgcaaaatctctggagaaggtatgggaagaaattacttgagccttcttgtgaatttttgttatggtttgatcataaataccatgcaaatatcctttgtcagtgtgttttggcagttcttccaaagagaccagggagtgaagaggattacagaaagaaggaaaatgaggttgattttacactagaaaaatgcagtgaagaattctacaacctttcagctacttttgtacctcattcctgtgtccagtacacattattgcataatctttctaaaaacaaacatacaaactttcagatacaatcaaaacttcattcttcccaacaattctgagagtaaccaaaattgaatcccatcatttgtcctagtattgtaactgttagggtgattttagttttaagagactgaaacacaacataccttcaagcagaaaaggaagtttcttggctcacggaatttaaggaaggtggtcaaccgaaccactgcaaggtgcacctcggcctcaggaacgagaagagctagaaatgaactgtcagaacatgcaatcttgtctgcttttctctgtatgtctgctttattctctcttcataaatcttctttttctagatggaaaataacaattccttcattccacattttatagctacagtcacttggcagaaaaaaaaaactgccttgatgctttttctggaacaaagtcctaaaatcatagggaagggatttattgaatttaattggatctattggctaccctggaccaatcaacaagttggcctggagaagagaggactgagattggctcacctgagcaacagagatcaattgtggctaggggagcaggatcacatggtaacacagcagctccttgggtaccataagccttggcaatcaggaaatggagaagcattcctaggacaaggtgaatgttgaagtactgggcagaaaaactgtatattactagcacctattgcacctcatggaaaaactacattagattcatgctggtgatacctagtttctgggaggtttaactctagcccacttaagtgaccctaggtatgtgagatatataaacaacagaatatctatacagcatgaagaaatatccagatggagcaaatggatttaaatgattgagtgacatcttcatgaaaccctttttgaatacttatctgagccctatcaaactctttcaagtatttatgaccactactacacagtttatcaaataattattctacagttgcctgagtattaggtctaagttcctagctcagctgcaggtatcttattttatgcttccttttaccaaaagacctctacaccaagattagtgttaaggacataatttattccacattcatcccataaatgattcttgagagcctactaatttctaggcaatatattcaatgcccaggatacaaagatgatcaaagatgaatccttaaagagagcgcatgatttgatgtattttgtccccatcacacttgacatagaaatctagcatagccaaatttgatctagcaattgaattacctctccaaacaacagtagtgtatctagatgcagttttgtttgcctatccagaaaaatcagaattttcctcccttttaagccaaaaggctattaatgcaaatccaattgaatttgcatatgattacatttctgatggaaacattcatatgcaaatgaaaattcatgcaaagatagccagatcattcaaatagttgctgaaatatcaagataaaattaggatattaaatgtacatccatctatgtttactaggttacactaaggtcatcaagtaggacaatattctcaaaaaacttaaaccatgtcttaacccttaacataaaccattgacaaccctcaagtagatacgaattcagaaaggagctattacgttactttgtgctgtcatagtactgaaaaagaagtcagtcactgataaaatcagtgaagttactcaaaagacattcatcatggctctgccattttgccccttttatcctttcttcccatcaaaagtaaaaggtgattttttgatagatctgatgttattttgatgatccaaaacaatgagcaaatactttatgcaagttgacagtttctacatactccataggggctcagtgatgcaagtgaaatgacatcatcacagtcaccaccaataagtatccattggaaagcatccatgacattgtgcatacagcaaggggaaagtgatcttatctaaagcccatattctttattaagtccagctaataacagatttaagcaaaatttcaaggtataaaatcttaatccactactgtacattccaaatctatttttgagggaaatacggtcttggaatagaccgttgttcttgttaaccttattagaagttacagaggcaaaaaagaaaggtttgagatcacagcattcaggattactggcgcttagtttagtggtccacatagtgtaattctcccacttccttttatttggtcccatatatttgtttatagtttcaagtctttttagaattctagtgttctttgctttgatgaatgtcacctaccatccatcaaatttggaaagtataaacctgagggaggtaccttagcatctcccaacttgacaaactgaattctttcccagatgaatctgaggaattttggatcttaggtatttctcaaatccagacacttccttcatctccatcatcaattccttaacagtatcttttgcctggcctaggacaggaacctcctaaccggattcccaggacctacttttctctttctccaatccctatcatactatagccaaggatgtcatctaaaaatgcaaataatcatagtttcatccagccatcctccttgcttaatactcttcaatagcttcctgcttcttttagagtaaaaacccaaatccttaaacaagctcttacctgctgcatggcctggctcccgccttactctccacccttacatcacgtggttcccctttcatcctctgcactccagcactgtcctttttttttaacatcctgagatgtcccatgcttgtttcagtcaccacattgcacatgctgctcttctccagcttctacatttagttaacttcatgcttcttcagttaagaccttcctgatcttctagctgccatcaggttcctgtgttactttttttataccaccatataactttctttcataatacttatctgagtttgtaatgatgtgtttactttggagataatatcagttgtattaatctctctcatggcttcccgaaggatgagcctagaactgttttctgctcaccagagcaggacatgatgcctatcacacactaggcattcagaaaatacttgttgaattaatggatagttccactttctattcccctcataaaaaatccaagttcataatcatgaaagcaaaaaaaaaaaattgcctagcttgcttgcgcatcaccctgccacagttgccaaagagaattagtatgtcaaatactataatattgtttatggtagagaagacaaggtgaagaatctcgtggcaccaaggttaactgctttcaaaaactatgataataggattccaccattaattgtaccagcaaagcacttttttcacctacttaggataaagaataatataacagctactctcccaactttgttagcataaaaatattatttatgatagctaagccacatcttatttcagaaacacatctagaggtttcaaatatacaaaatcttatgacacaagttgctaaaattgagttacaactgttattcatttcacaggaatagagtcataattacaaaagttaaagtcacatcaaaatcacacaccagtttcttaactccctctgttactttttattttatttctatcagctgtgagcttaattttattttcagcagctttaaaatacggaactaaagattaaaattatagggaaagataaaatgccacattctggtgcttttttttttttaacaaagttgcattattatctgtctaggaatatctttccttttgcatctgtctcagactatgtagtcctggctgtctgtgacattcagagggtggagggttaaaaacttatatttagcaacaggatgtatctgtggttagggacgctcagtctagtggacaatgaaaaattaaatatacctttcttagaagaaaatgaaatttcagatagactattaaaataggcttaatcttatattatctttaatgtttatggatcttagaatgcagttgttggctttttaaaaaaaatttatgaaaaacattttaaatttctttcattctttgtatatacagactaatattccaggaagaaaaaataaaataaaatgtgcttatttaacttgaaggaaagtgcccgccttcttgcatatattgcaagaataagcattcagtcaataatcggtcatcttcaacacttcttacaaataaactaggttttgtagtctattgcaagtcagcatttctcactggctatgatggagatggacttgggatcctaggaagaaggcccggaaacaacatttcttctccttttatgatttcagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatggtgaggctgtaaatcatttttagccactgcactgacctctgcagctgttacaattacaaatgcactacatgcctgggtgtttaccttaaaatttgaagaacagctgcagaggcatggaatttcatgagcaaagattagaactgtaattttagggtattgtgaaatttttttgtcagcaaatttgtgtcatttgtacatccaataaagaacaagaacaattagagcccatttctaagagataaaaatatctaaatgtattcctatctttctgaaatattttacttttgaggaaaaaaaagttgagaccgacactccctcaccttttgttcttctccaccgacacctgaaacgccccttcacactgtgagttcctgagtaatctgtggctacaggtttcataggaactgtcagtcacctaaagagaatttcctcatttatcagctgtttaagtcccccccacccccccaaaaaaaaaaaacctgaagtaattaattaatttttgagcacagtgtgagctgattccgacaagtctgtcctgggcatgcgaggggactggtgtgcgagggggccgggtgcaatgatggcactctgtggagcagattgcagtgattcctgtcataccatcccgggcagtcagcccattagctgccattgatttactgaccttttggcccgcttctctctctctctgtctctcggctacagacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcaggtggggggatggttttaagtgatttctttctataataaccccttagagaaacgatattgctttgattggcaatcattattaatttttcatggcattttgaagatgcagatcttttaatggtaatagctttaattgaggtctaaatgattttttgatggtctcttctaatatgatttaatagtcttatgttcacgatcgaatgagtgtgttaatttctaatttagaaattttatttgcactttaacttgactttagtttcatttttatgttccacaaaaagtgaatgaaattgtagcattttaattatacattattaaacatctcagcaattttaattccatttttcacctcgctttacttagaaattttcttttcatataggatctaagtcatagaaaaagaagtgtgtatttctttcatttttcatataacaccttcaattacttagagtatttttataagctgctactagtttatgaaatctgattaagtgttttaaggaaaatcaaaaaggcatatattatctgtgtatatataatatataaaataaattggattagtactaaaacgttggatgtacattaaaaatgatcccttaatatacatatttgtagctaaatgttaaaattactccccctctttttgcttacttgtctcaaaaataaaaactctgtcttcaacagttaagtatagcttcttaaatctttaaaacaactgaataggattgattcacagtgttccttaaatgttacatcaaaactcctctttcccactgggaggattgactctgcaaattgatattatgatatgtttgcatggacagaagtggtgtgccttaagtcacaataactggccctacagatccggaatcacttaatttaagtcttgacaccatgtctgtttttaaaattattgaacatgatattgtattcaaaattcttaggttttccttataaccttcattttcttcgaataaggaaaatgaggataagcaaacacagtcaataatggtgataagactagattatggaattttactattttaggagaacagctcatgtaaattattccatttatatctgattgggcttgtcacctgaatgcttttcaaagatgagttataaaaaatatgcttgcatagttgcacttatgtaacagtttatctccccttgcttatatgcacaaaaactcaaggaaaaaaaaagtgcctagatatttatctagcataaccgctttaaatttcacatgcagaagtgtgattgtgttggcgcattatgaatggtagctttggtgttgaaaagtcccctcatttgctcatggcatttacaattagtaaattaaaatgattgtatcatattaacagtggcacaactaaagtttatagtagtcctctgagggctgtggggggagacaaagcagctgttgctgtttgtttatgcaactcagcaacatatgagcgctggtccctcaatggcgctcggcgggctgggctctgcttgatctttgaaggttgctgctgtttgaacaaacctccctgtgtcccatgtaacaccatctgtctcactaggaatgtgggaagattcagcacaccctagcagttgtcataccgtttctgtgctgtctttttgcaaaaggcttttgtgtcattgctgctagaaaaaggctgacctcctaccttgagcatccagagtggatgactgcattttttttccagaattctaagtcacactgcttttttccccttgttcaaaaaggtcagctgtgtttgattatatctttgctgcttttaacttgtcttttcaggaaactttttttccttttttgtccctactccctagcacactactaaaaaggaaaatgaaaagtcgttgaagtctttcctactggcctgtgataaaactgctcaagcagctataacccaagatgttgtctcttacgtttgataatgaatcaaatctgataggcgacacctcaggaaaaactgggcttatatttgctactagcacaatgaataggatatttaaacatgctcatcatgtaatgaaatatttatagtcaaggtttttttgtttgtgtgtttttggtttgggattgggttttttttcttttttaaattttagattgcttcagtataagatatacttttatgctgatacaaaaaaattgataacttttgttgtgtgggggtggtttttcttgagactattcagaattttcaggaaaatatttttttcttgacagaattgtcacattctagcagagaatgttcatattttagaatttgtggtaaacacgaaaaacaacaaatatctttacagttatacttcctcgtccccaaaggttcaaagaaacattttggaaaagacactacagaaataattctaaagcaagtgttggatgcgcatgtgaaagcacttttttttatttgttccaattttattaccaacattatcacttttattgcaactctgaaagactgagcagataaataagcatgcactcaaaccttttggcctgtctgaaaaacagaggccttttaaaaatatttgtaacaaattttctttgttcctcctgcacaaaactgatgtcagtctttctccttttatagcaccaaatgctaacccaaggagcaggtaatcgcaagttcaaatgcacagagtgtggcaaggccttcaaatataaacaccatctgaaagaacacctgcgaattcacagtggtgagtagcagaggtgctggagctcgcatttgcattttacttaattaggggagttttaaaagattgtttaaaatttacacagtcctatttgtagctttttggaactatctatttatttcatcaactctgtgtgcctgatttgtgttcatgagacttatggtacaaccagtagcactgtcttataaaaagaagcagaatgcttacatgtcttaaaaattacaaatgctttgatttattacaaaatctagaggctcctttttgtccttttaaaaccgcttctccagaataaatatttctgacctgaggaaactcaactggcaaattctgaaagatattaatttttgagacctacccatgaaaaaaagggtgaagaattttggataagagctatgtatgataaatactccctgattcctgagggccgtggatcacagaacagaatcctaccactgagatttcctctttataactagtttgatagctctgccaagcattttattaccaagttggatgctattcaaaggactagttggattggtagaatcaatggaatctccacaaagtttattaaagccatggctacacttgcctttaaatactgtgacatctttattgtgctattgaccacacattagtctgacactctgtttaaataggaggctgccgatggcagacaagatttgggatctcagctgaaaaaggcatagatagcccttaccttccactgtgaacatcttgaattatgtcctcccagggcagataaagttcagaaatggttatggtcacataattctaatctaagtacctagaatgtagaggtaccccattgtgttccttttgtttggtttcacagattcttctcttggtagacaattgcaattgttatctaatcaaggaaatgtaacggtaattttaattatcattttaggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcaggtaaagagacaaatgtttttctgctatgaagaaaagaggtggcaattattttgattatgtgcatgtaggaaaaaaaaatcttagtgaaaaaactcagcagaaacagaagagtttgctttaacatgaacctaaaaccatcagtgggctagaacaatggatgaaacagtggatcactgtactctaagcacatttgctttaaaaacaaaaaggataaagaagaaattaatatttattttgagatgtatttagatggactcatctgcttttaaaattaaactttggtgaaaatatttggtaggacttacctaggtgctagaagttaaagtttataaccgtcacgtgcttttaaagatgtacacaggacaggtgtgatggctcatgcctgtaatcccagcactttgggaggccaacgagggtggatcacttgaggtcaggagtttgagaccagcctggccaacatggtaaaacaccatctgtcctaaaaatacaaaaattagctgggtgtagtgctgggtgcctgtaatcccagctacttgaaaggctgaggcagaagaatcacttgaacccaggaggctgaggttgcactgagcagagatcgtgccacagcactccagcctgagagacagagcaagactctgtcttaaataaataaataaatataaagatgtgcacaacttgcaataatgtatatacacattttaataggtacatttgttttacagagaatggtttattttgaagagtattcttaaaaatatcttccatatttcacatgacttcttaccaaatcttcaaagtagttaataattatgctttatcaaataggaaagcagttatattttaacattatgcagcatataatctttgtttgcaaaataggagcataagtagcagtgcacctctgtaacagctgttccagtattccaatttacagtacatctgccctctttgtaaatgtatttaagcctatttaatcttctctaatattaattagtacaaacatagtctaagaaaactgaactgtgggctagcaaatggaaatgtatgttatcatgcaagtttgcactcctttggatcaagacaaaataaatatcaagaaatttaataatttactgatccacattcattaatgttcaatgctgaaggctgttttaacatagaacattgataaaaagtgttattaatattccctatttcaaattagaaaattaaatataaaaatatagcttgaggcctttagttggtagacatacatttaaatagattgcataataataacattttgtacctaaatataaaattcaattaaaatcgggtttctacagctacagatcatttctaaagttaagcatactggaaaatacacaaatttcaatgttaaattttcacttatgggtatttcttggtataaaggaaatgaaggattttagaaaaatttgtttctctcaccttcagagttgaccatttcctgtccttaaaaaacagtgagatctaccttccagggcagagaagtttatatttttgttgcgtatattgttgcatatactgcatattgagacctcatatattgttcatggaaaaaaaaatgtttaactcaatcaattagtagcaagcaattttgaggttctccaaatgtccccctatgtgaagttgtttggtgtgagcacaaagagaagccactgtattgaactgtgtgattctatcgcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggtatgagtgactttgcctaactggttagagcttcccgtcctgctgtacatttcataatatttaatgagcacacttgtgcaacataagatgtaacatatgctgataccttcaacaaggaagaaataatgcttttgccgagctcagtaggacttttttgttgcctgtttattggatcattcatgtctttatgagtgtgcttgtcttaatatctttccagttattctgtaaaccaaatttagaaattatgtcaaagggacagtcagatggccagggcaatgaaatggcatgacacagccagttattgaaaataccttcaaattcttaagtttcaaagcttaagatgaacctatatatgtaaaaatctaataagaaattcagacagtaatacattagtttcatcatccaaaacaccaagaaagccataatttaggggtaattttgtttgccttttttttttaaattcgccacattttgaaagaactaaaggcattagtgtcataaaagaaaagtaatagatcagatgagctacttgaaaccacctatatttggaagattgaaataaaactttctaaattttaattagtatatttccaattcatgcattactaattaggaacaattacaaagagttgacaagaaaacagcctaattcttcactatgagtagagagatagtgggttaatttttgaaaagaaagatgaagtaccatatgtaatttaatattacttcccacaatccaagatctgcagctctatggttgagctccacttgtgtttcctccctggctccatccccacctccctgaacaataaggtagctgaacctcatccctacccctagcccatctccaattcttctccactggaaatttggcatgctctattagccctggatcgggggggaaaaagtgtaggatctcagtcaaaattttggcacgagggaacaaaaaaaataggggagtataggaaaacaactcattctaaaccaggaagtctagtatcaaacatttcaatatggaggaaaaaaaactagcactttggggggaaagctttttgggggaaaagcgatgatgaggcacaaaagaaaaagaaggaagacagaaaagggaatatgagccaggcgcagcagctcacgcctgtaatcccagcactttgaaagaccaaggcaggaagactgcttgagcccaagagtttgagaccagcctgcacaacatagtgagaccttgactctacaaaatattttttaaaaattagctggatgtggtagctcaagcctgtagtcccagctacttgggaggctgaggtaggaggatggcttgagcccaagaggtcgatgctgcagtgagccatgattgtgccactgcacctcagcctgagcaacagagtgagaccctatctcaaaaaaaaaaaaaaaaaaaaaaaagcgaagggaaggtgaatacttcctgtcatattttgactacctagatacaaggcactcttttctgtcactgaaaactgtccttgggaagtactcgtactcatcatcggctattattcctcactgggcacatgctggaggcagctcaagtgaccagcatcagcctgatagtgtggggagggtttttgtgaagcaacaaggttgataaataacagggttcttactccaaccaatacagttttctttttctttagctgtctgatattcattgttattattttaaaagtttaatgataccttaaagacaacccaatctaaatccaaacagcttttatacttgtgttatataattcaatgtttgaaacatcaaaattttcttttagtgtagatattttctttagtactaagtgctacttaagcatttacaaagtaaagatattttcatacctaaattttactttaattttaatattttaatcaaccttaaatatattttgtattccattattcagctacaataggcacatcactgaaggcatctttccctctctgattggttttattatatgaccatatgcaaactctatcatttactacacggtgagtgtacaacttttattttagtgagggctgtcatacacattgacatccagtcaatatatttacttcttataaattagagaattgtaaccttcataggtctgtagatagttgagaggcccaaaagttgacaaacacaaatatgcataatttatttgaaaaataaacttcaggcctgatgcggtggctcatgcctataatcccagcacttttggaggcagaggcaggtggatcacctgagagcgggagttcaagaccagcctgaccaacatggagaaaccccgtctctactaaaaatacaaaattagctgggtgtggtggtgcatgcctgtaatcccagctacttgggaggctaaggcaggagaatcacttgaacccgggaggcggaggttgcagtgagccaagataaggccactgcactccagcctggccgacagtgtgagactccatctcaaataaataaataaataaataaacaaacaaactttgttttttaaagtaaaaataaactattctgctccttcaagatgtgagagctgctgcctcgaaacattgcctagcaacaagatgctaatcattcaatggttgctctaaacttgtgattaattatcttcctgttggctttccaacttgtcaagtttccagcatgttaactttttggtcacttgaccaaacatctcatgacattactactgtcagtgtattaggttctattcaaatcaagttcttcatggattttctattgatgtgatgtatgtggaaatttagtccatgttcctatcccaattgaacctgtgggatagttcctatcccactagcctttcatttgtttacattaagcactagtaatattttgagaatgcactaagatgaaaattataagtgagaactgtcttgggactgactgattctaaggtcgggaaataaaattgaatcatcatttcattatgcattgattatgaatgtgtccttggtaaagtgtgtttgtgatgtctgtctacaattttacatatagaatcgtttaacttaagaaggaaattatgagctacttattcttgagacccagtgctttttttgcctcaatttatttcctaggcagataccaaagtcatcatgcttcatttttcttaccaatggcttattgcttgcttgcttttcctgggacctgggactgggacagaggagggaaacactatgtaaatgttgacttcaacagaattaattgtcacaaacaaggactgtgaaattaaaaactctgaaactcctgttaggcactgtcaagaactcatttgtattctaaaatttaaatctgacctttattgagtgctttctctgttgagacatcatggtaggtgcttttgaaacccaccttatttagaaaagtaatacaaatgtttctacttttgagtagataagtctaagttttaaataaatttaccagtcaatcttgtttctcagttatatggtaatttttttcataccacaaacctttcatttattattaagttcagttaccattctagctgtcaggtgaatcacaaatctagatattagagaaaatatttaccctaagaaagcttgattcactcagtatcaatttggatgttctgaatcttggtcatgtggaaatttaattctaggacatcttgatttgaatcaggtaaaccagcaaaacaagttaaaaagagatgaatgtccaagtcagttactatttaaattgaatttattaaatgcttaccactgaaacttctggagatcagtagactatttagtgtaaggtatatgtcaaaactctcacctgctcccagattctatcctttgcatggtatcataactgaacattttattttttcaggttgtcaattcataatgcaggattaatatatgcgtattataagcatactgtttattatcgaatgagttctctgaaaattgaatgtctataaccaaggcatatctctaagacagactgcagtttagtgggcatgcccgaagcattgctaacgggccttgaaacctataacagaggatgcttgctctctctggacactgctctgtgttttgttgctttggaaaagaaagccatatcataatgttcattcaaaattattcatacagtctcttccagaagttacctaagtagttgacctttttgtgctcctgagctaatgagacattagtatccaaaagaggttgtaggacagtttgcccatacacgccgtagcaactagagcatcaagaaaattttcatctataatttctcttctctctattcagatttattacttccatgtactctgctcctgctgcatgcgtcctacttagaacttgagaaattattgaacatgtattaatgaataagaataacatgatctaacattaactgactgcctactatgtgcaatccttgtactaaatgctttatataagttgtcttccttattctttatgcccagtccatgagttaggtccccaaatgatcttccttttacctactgatcctgagagaagttaacatgcctgagaatgcacagcctgtcataaatgatggatgtgaacccagataatcatattcatttaacactgcccctatggatgaattgctgcgactagaaacgtcttatcctttctcctgacagcatcctttcctttaaggtccaagtccacacaagtgagaccaaattcataacataatgacatgaagtttcccgggagacaaaacctcttgtctttttcccaaatacacgtctgcttcctcttaaattaccttcctaccacggtgtctttccaaatggaaaagcatgctatctttgcagactcttggcactccattgggattctctgttatccagtttacctcattcaaaacatcttttccaaaagttaaggaatggttcttgtgtggtttgaattatacttgctttcttcagagtatgagctaccttgaagtaggttattagaactgtctttatttcccatataactagtagtcaccaacaaatatctttctgatttccactcttccagttaaataacttctttctactctaatattataccttactacatttatcatcactaaatttctagtggacattccagttaaataaagaccattaatgaaatgacatatagcagtctacagcactttccgaatagtggcatgccctggaggcattcaataacattattaaagatatttaattactgattgagattttatatcaccatataactgaatacctaaagtgtatagaatgggtccctaaacttataacatgacacttagcaaacgaaaatgggattggatctactttgttgggttttaatttaatttgctgaaatgcaagtttgtattaggaaataaagcatacaacttcatatatgttacagtgatccatggcactctacatgacacatttctgactttaactctggagcatcaggctgataatttttttttatcagttctattttggaaataaactttcaagtatggcagctatggaaggtgttgaaggcattccagtgctatttgtggcctggaatcaaccagatgtgtttaggcttggcactggctttaagttccaaacactggttagaaactgcctggaatgccaaaggaaatacagcattccctagctgaagagtattttaacactcaacaagtggctgacatcttatggaaaactttagagggaaaacactatttggaatcagttcagcctccatgatatacaccctcctaatttgtattttctaatggtttcttctctgatttttattcttagactcctatgactgataagacagtcttgacatcctctttcctctgtttcttccactccctcctaacttggcagtttgctcccatttaagacctaagatcccctttcaaagcaactatctcatgatataacaagcagaggatatacatgccaatgccagcgatgatgccatctttatcacttttgtacaagtctttgttttaaaaatgtaaggaagagaattacctgatgaaaacatgtgctagatcactagaaatgtcttgttgaatagaacatttttccaagttttaaaatgagacaattagcaatggaaagcttcctgtctgagaattttcctccagcagctttctaagttcttcttgtttattaactacattgcatcagcaagcattagaaaaccaaattgtgggatggaaatgcatcttcctaactctccatcgattagaccggggtgtgttgatctttcaggcataagtacacacgcttatgcctgagtctggactcgcgtacagaattagtggaaagagacttcatgcaaagacactaatcaccctgtcatcttgttctttctcccaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaa

SEQ ID NO: 202 - DNA, 84890 bp, Homo sapiens
ccgcgcgtgctcccgcccctcgccgccgctcgctcgctcgccggccggcggcctccgctcggccccctccctcagctccggtgcgcggcggccgacgacccgcgcggcctgggcctcggcccgcgccaccggcgcccgcgcggagcggcccgggggccctcacgcaggcccatggcggcggccgcggcggcgctctcgggcgcgggcacgccacccgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgagtggcctcggggcggggcgggcggggtctgcggcctgcagcgcctggcaggacgggacgggacacgcgcccaggcccgggaccacccacgagcgggggcccgactctcccacagccgggaccaccagcgggacccaggccccggctggatcccaaccctcgacagcccctggccccgacccccgtcctcccggtccccttcctggcaggtgcagccccccgtctttcccccttcctggagccggggctgcgggcggctgcgcgcgcgggtcaaggtttctgggttctgtgcgtgcggggagttcacgtgtgctgtttctattctgcagcgaggtcgcgctgaacagaaatgtgaaaacggtgtgcggtgggaggaactgccccgaactaaaatctatgtctcttaaccgatgaagggttgtctgttgtcttttgttgttgttgttgttcagtcgttttcagtagtgagctgtttcaagagtgcggtgttttaagcaggaaggactcctttttccctgccgtgttttcagtaggccaaattggaagacgcttcaagcatgatggattttcaatctgtgctctgaaccttaaaatttagggaaaactagatgcttttcgcataacttctacaaaaagacagttgattaggaattattacaaggtcatgtagagtgttaagtcagcctgatagggaactgcctatcctgctacaaaacaatttagcttggtcctgtggttttatgaagttatcgtttactctgcttgaaacacaaacttgctgtctaggaaatgctaattattcctcaggggctcacttctagatcattgcaagtacagcctttgtccacacaaactggaatttttttgttttttgttttttgagacggaggctcactttgtcgctcaggctggagtgtagtggcgcgatcttggctcactgcaatctccgccctttgagttcaagtggttctcctgccccagcctcccgagtagctgggattacaggcgcctgccaccgcgcccggctaattttttgtatttttagtagagacggggtttcaccatcttggccaggctggtattgaactcctgacctcgtgatccacccgcctcggcctcccaaagtgctgggattacaggcgtgagccaccgcgcccggcctacaaattggaatttttaacgctttcggttgttggagatgctggtaagagctgttgcttttcttcttgacttgcgtgttgtgtgtgtgtgcatgcgctgttctgtttcttagcatggaaaggtgcaccagcatattccttaaactttggtagtagcattttaaagaatgttattttcaggccgggcgcggtggctcacgcctgtaatcccagcactttgggaggccgaggcgggtggatcacgaggtcaggaggtcgagaccattctggctaacacggtgaaacccgtctctactaaaaatacaaaaaaaaaaaaaaaattagccgggcgcggtggcgggcgcctgtagtcccagctactcaggaggctgaggcaggagaatgtgaaccctggaggtggagcttgcagccagcgagatcgcaccactgcactccagcctgggggacagaggaagactccgcctcaaaaaaaaaaaagaaattttcaaatgaaaatgctatttatgtgtgtttatactgtagacggtatgaaatcaatggtagggtcctaatggctaccctttaatctgacttttttttttttttttttttttttacaaaatactgtgtcacaacaaaggaagtttgcgtctactgtgaggatcttgagtttttgtttgtttgtttttgattttgagacacggtctctgtgacctagcctggagtgtactggtatgatgacagctcactgcagcctcaaacttctgggcacaagcgatcctcctgccccagtgctcaggagtttgaagttgctgtgagctatgattgcaccactgcattccaggctgggattacaggtgtgagctatgatctcaccactcctcccacatacctggccaagattttgagttttttggaatttttttttttttttcctgagacggagccttgctctgtcccccaggctggagtgcagtggcgcaatctcggctcactgcaagctatgcctcccgggttcacatcattctcctgcctcagcctcccgagtagctgagactacaggcacccgccactacgcccagctaatttttttttgtatttttagtagagacggggtttcaccatgctagccaggatggtctcgatctcctgacctcatgatctgcccgcctcggcctcccaaagtgctgcgattacaggcatgagccactgtgcctggcccgattttgagtttttaaagaaaattctcctcaccattcagccagaacgatttgtattgaattgaattctgcacatgctaacatgataaacatggagataagttgacctttcagtgagggccagaattcagaccttatttttttgagacggagtctcgctctgttgccaggctggagtacaatggcgtgatcttggcttgctgcaacctccgcctccctggttcaagcaattcttgtgcctcagcctcctgagtagctgggattacaggcacacgccaccacacccagctaatttttgtatttttagtagagatggggttttaccatgttggccaggatggtcttgatctcctgacctcgtgatccacccgccttggcctcccaaagtgctgggattacagctgtgagccaccacgcctggccgaattcagaccttttgaacagtaggaatgagtcttgcagtagagatgagtaagaagggcagtgagatggaggctgggcctcccacttgtgctcagggaagagtcttgtggccaccgaggtgaacatgtatcctggacttctcatgggcctgggactctctacccgtactgagtacacaaggggatgagtggcttttttcacagaggggagtttagcatttgtgcggtgtgaattaaattattaacctagaggatatttcagcacttccttttttgtaaggtatcatttccaaatttgtggtgtagggcagtaacacaggttaatggaataaatcataaagaattggtaccagtgaaatgcagataaattgtttaaaatcttttttttttttttttaagacagagtttttcgctcttgttgcctaggctggagtgcaatggtatgatctcggctcattgcaacctccgcttcctgggctcaagcgattctcctgcttcagcctcccgagtacctgggattacaggtgtgcactacaccaccgcacccagttaattttgtatttttagtagagacagggttaatccatgttggtcaggctggtcttgaactcctgacctcaggtgatctgctcacctccgcctcccaaagtgctgggattacaggtgtgagccaccacacctggccctaaaatctttttttctgaatttaagctcagtgttcaggttgatgatacaagttctttttaagtttaaaaatcaaattaaatgtataagcttgaaagcacacgtaacttagagtaattatgtaaaggccaaagtattattacgagtctcactctgttgtccaggctggagtgcagtggcgtgatcttggctcactgcaaccttggcctcttggattcaagccattctcctgcctcagactccccagtagctgggattaaggagcccaccaccaggcctggctttgtgttttttgtagcaacagagtttcaccatgttggccaggctggtctcaaactcctgaactcaggtgatccgtcccgcctccgcttcccaaagtgctgggattataggtgtgagccactgcgcctgtcctaaggctgaaatattattaatgcttatttcagatttgtctactaaatttaacatcactgtagagttagaaaataatgtaacaacccgtcgttggtctcttatttgaaccacaatgattttattcaaattccaacttcaaaatgaatttatgttttgaatttatattaaaaattatcagaaaatttgcaagagtacataagtagtttaggtttaaaatttggctcatttcattgaaataataatgtattaatgtgggggaagagagaaagatgaggactatgatcctgtccttgtctgctgtattttaataatttgactaagatgtggatccaagtactgtttccacagtggctggggagcctcgagcccagtgtgattggtgggggctcagtgtgtacaaagattgtcagggtgtgtggttttctggaaaacaaatggcttcttcaagtccttgatttttggatacacaggatgcagggctgtgtgtaaggaaaggcagcgttttcctctcttagagcctctgactgacctgaggcgcaggtgttcctgggagactggagggtgggctccatgggggtgtctgggccccacctggcagggctcttggcagtgagccagtggaggttgcctcccacgtgtggctggccctgtagcctggctctggagaacctgcaattcaggctggaagagactttggagcagctggagtgtgaggtctgcctgggtctggtggggagtgtttttactttgccagtgatagactgaaatgccctctttgaggacaaggtggctttttttttttttttaaatcggtctctgtctgtcgcccaggctggggtacagtggcacgatctcggctcactgcaacctccgcctcccgggttcaagtgattatcctggctcagcctcccgagtagctgggattacagatgcccgccaccatgcccggctaatttttgtatttgtattttatttatttatctattaatctattttttgagatggaatcttgctttgttgcccaggtgggagtgcagtgacgcagtctcagctcactgcagcctccgcctcctgggttctgggttcaagcaattcttctgtctcagcctcccaagtagctgggactacaggtacgtgccaccatgcctggctaactttttttgcatttttagtagagacggggtttcaccatgttggtcaggctggtcagaactcctgacctcaggtcatctgcccacctcggcctcccaaagtgctgggattacaggcgtgagctactgcgcccggtcgaggacaaggttcttatttgtccaagggcctggtctggaggctatgattagtaaagtgttttttaggaagatcaattggacaggacagtttgggtttgttgttgctatttttgttgccatggtaacaaactaagtataatttatgaataaaaataggcaactctttaacagttgtttatactttgaaaatgtcaaatgaatttgacacattctgatcagtaagatcccagaatatctaatagtcaaatataaatagaacaagttgaatttactattgcctacaactatttaacgtgctaaattaaaactctgtttatttagaagagtgacccctgtcctatgccaaatgaactctatcagttctacccagtggtaattccacactttctttcttacgtggcctgaatcccacactttctttcttacgtggcatgaatcccacactttctttcttacgtggcatgaatcccacacttactttcttatgtggcctgaatcccacactttcttatgtggcatgaatccctcactttatgtggcatgaatccctcactttctttcttatgtggcagattgtgtttggtaatgtcagatttgaagacttgtttattaaatcagagacagtatcttccaaggtgaagactggagagagatgagccgacagtcagtggcttctggagctttccaggtggagactccaataaatgaattgagggaactcacagtgattctgtcctactcagaatgcagatgggcagaactgagcttcccggagaatcccagtaccagaaagaagaagtaagaaggagggggtcctgggaaggagatggccaagggacatggcttggcaatcaggaagtcttgggcagcctttgagagggctgttgtctccaggataaggaaggaggctggacatagggctggagaataaggaaggagtggaggtagaaggagtgcatgtaaagtggggaccttgtaaggagagcagagttgagattagggttaggaggagcggaaacctcatcactaaggtgaagtggctgaaggaaccaccaagaaatgggagttgaggctgggtgcggtggctcacgcctgtgatcccagcactttgggaggccgaggcaggtggatcatgaggtcaggagattgagaccatcctggttaacacggtgaaacctcatctctactaaaaatacaaaaaattagctgggcatggtggcgggcacctctagtcccagctacttgggaggctgaggcaggagaatggcatgaacccaggagattggagcttgcagtgagccgagatcgcgccactgcactccaacctgggcgacagagcgagactccgtctcaaaaaaaaaaaaaaaagaaagaaatggagttgaggcctggtcagctctttgccgagtagacagcagacgatgtctgaaggaggacagctcccagtggaaaagaaaacgagattgtgttgtttgaagagctgagcagagcgggtcggaacggagctactaggaaagtctggtgtgtttccgtattgaagggctgcaaggtggctgaaatgccttcgttttgcgacctgaaactcctgacaagcttgtgagtggagctgagcctgggacacaggagttggcatgtgttggcataaataaagggatgttcatagcagagggcaaatggcgctttgcactttgaaaagtgttcagtgtacaaatcagttgcctttaataactactctgtatttaagctccgcctcctgggttcaagcgattctcctgcctcagcctcccgaggagctgggattacaggcatgcaccaccatgctggctaatttttgtatttttggtagagatagcttttaaagaaattttggctgggcccggtggctcttgcctgtaatcccagcactttgggaagccgagacaggtggatcatctgaggtcaggagttcgagatcagcctggccaacatggcgaaactccgactctactaaaaatacaaaaattaactgggcatggtggcggatgcctgtaatcccagcaactcaggaggctgaggcaggataatcacttgaacccacagggtgaaggttgtggtgagctgagatggcgccactgtactccagcctgggtgacatagcaagactttgtctcaaaaccgaagatattcatttggcaaattgagatacattgttatcactgatttgtagacacagaacacattgcagctattttagcataattgttactttaagttaaaaacccagtaaccaacttacttctgcctcaccttagtgtttagtacttcttccagtggtaaaactctgtgttccttttattttattatttagagtctcactctgtcacccaggctggagtacagtggcaccatcatagctcactgcagccttgaactcctggactcaagcgatcttcccacctcagtctcccgtgtagctgagagtacaggcctgcatggccattcagggctaatttatttttttttggacgtggggtctcgctatgttgcccaggctggtcgcaaattcctgtcctcaagcagtccccccacctcagtctgccaaagtgctgggattacaggtgcgagccaccctgcctggcctatacatgttttcaagtgctgatcatttattaatagtgaagtgattgtagtcaggcgtggctcccccatttactggcaggtcccatttagacctgcggttgcagaagtacagcacagctctgtgcatgattggtggaaatattccaggagatgaggctgttacagtaacagcagatttttccattgtgaaaatgtaactattcctgctttgttgaagagaaagatttttttggaaaatgaagaaaagaggatttctaaattaaggaagcttttagtgaaagcagttggcatttgggtagtagtattcttatctgtttaacatttttgtggggctcttgttttcttttatgtttggtttttggagcaatttataatatcttaaataatgacagtcatagtaaatcaacctccacactttttcatgaggaatttttgaatttgctgctaaaatgcagtacaggagggcatgtttaaggcacacattaccatctctacaatgtgaagcgggctttgagcacggaacaaggtgttacagctgtacctaggaagtggtggcagggagaccagaaagtacctcgtgccagagccacagcccctgcggccctgctttcctcgtgcacgtcagtttagagtgcacattgggcttcaaacgcctctgctgatttgttaggaacagagaaggtgctctgctgagaattccgtagatttctagacagtatttggtttttgctgcagtttgtcatttgagatggaatgcttgtgttctttgtcctgtgaagggcattggagtacgacaccggggtgagtctgcctccttcccctccctgggacgtatgacagtgtctggaggcacatttggttggcatagactgggaggacgggtgctactggcatctagtggacagaggccagggatgccactgaaaaatcttacaacgcacaggacgcaggaggggagagccgcctgttgcgtagcaacctggcagctgataatataataaaagttggttatgactcttggtcctactggtggtaagttttaataattttttttacagatgattcctgcttaaaacctttatgctaccaaagcatctgttcaaattatacttgaaagcgccttttttttttttttttttttttgagacagggtcttgctctgtttcccaggctgaagtgcagtggtgtgatcttggctcattgcagtgtccacctcccgggttcaagcgattctcctgcctcagcctcctgagtagctggaattacaggcacgtgccaccacgccggctaattttttttttttttttttcaagatggagttctgctctgtcgtccaggctggaatgcagtggcacgatcttggctcactgcaacctccgcctcccaggttcaagtgattctcctgccttagcctcctgagtacctgggattacaggcgcgtgcccactcccagctaatttttgtatttttaatagacagggtttcaccatgttggccaggctgatctcggactcctgacctcaggtgatccgcttgcctcggcctcccaaagtgctgggattacaggcgtgagccatggcgccccacctgaaagtgccttttgtaaaacagagcctggaggttgagactcattgcggagtcactagataactcctccctttgcagctttgaaaggacactctcggaatgcagttctgtcttgctatccctggttgtaagaagatacaactaggtcccttaaggcagtagtagcctaacattgttacgtttgtaatgtgttctcttagtcgtatttattgacttaattaggctgatacagatattctgagaactaggaataccttagttacattgatacagatattctgagaacgtttatctttagtgggaaaaaagacaatgagctgtagctgaattgttccagttttttgtgttcctggttccactggagaatgaactgatgatgtgacgtcattgttagcacagccacgctgggaaagatggctctcaaggtgctgtttttaatggtgtttagtcattaataattggcagtaagaaaactcatcttttgactttcatttggacagatggaatatagaaaacctgaaataggccgggcacgttgggtcacgcctgtcatcccagcactttgggtggctgaggcaggcggatctcctgagatcgggagttcgagaccagcctgaccaacatggagaaaccctgtgtctactaaaaatacaaaattagctgggtgtggtggcgcatgcctctaataccagctactcgggaggctaaggcaggagaatcacttgaactccagcctgggcaacaagagtgaaactccatctaaaaaaaaaaaaaaaaaaaaagagagagaaaacccgaaataaggaaatttaaaactactgatgtgttttttttttttttttttgagacagagtctcgctctgtcacccaggctggagtgcagtggcgccatctcagctcactgcaacgtcctcctcccgggttcaaacaattctcctgcctcagtctcccgagtagctgggattacaggcgccaccaccacgctctgctaatttttgtatttttagtagagacggggtttcaccatgtgggccaggctggtctcaaactcctgactgcaggtgattcccctgtcttggcctcccaaagtgttgggatcacaggccaaagtgtgagtcactgtgcccggtctactgttgtgttttcaaagtggcttttttggtcttgtatttttcagaatacgatagcattttgagtatatagagaatgttttaaaaattctgtgtttttgccatttctgagctgttggaggatgttaggataatgaacatcattttgatagccatttgagctgggtggaagaagatgtggtttaaatataaaatgtctgttctgggtcctccttgaggacctgttcccactttgccaagcttccccctggacttgtccacacgtgattaaacacagctgaaatcctgtacacttgagtgaactgcatgtaagtgttctgtgggctgggctgattcatctttacattgtacacttcctggggttgtagcctttgacccctgggtgacctcctccaggaattctgggtactcgataggactcaaatgtttattgctgaattggttggatgtgggcttctgagtttggattgggtgactactgtaccataggaaaccatgtaaaacagttataaatgtaagtcagattaaattcacttctgattctacagttgctcccacttttttttgtttttgttgatggtagactccccaaagtgacttttttggccttgtacagtcatgcatcacttaactgtggaaatcattctgagaaatgcattgttaggtgatttcattgttgtgcgaacatcatagagcatacttgtacaagcctagatgacacagcctgctgcacacccaggctgtgtgtatatcctgttgcgcctacagccacatgctgcacaaacttaagcaacatgtgactgtattgaatgctgtaacatggtgtttgtgtatctaaacatattaaaacatagaaaaggcacagtaaaaataaggtacaaaagataaaggtacagctctctagagcacttagtgtcagcagagcttgcaggacggggtgagtcagtgagtaaatggtgagtgaatgtgaaggcctaggacgtgactgtacaccgctgtcaacttcataaacactggacatttaggctatactttatttatttgagaaggagtttcgcttttgtcgcccaggctgcagtgcaatggcgtgatcttggctcactgcaacgtctgcctcccaggttcaagcagttctcctgcctcagcttcccgagtagctgggattacaggctcacgccgccacgcccggctaattattttattttattttattttagtagagatggggtttcaccatgttgtccaggctggtcttgaactcctgagctcaggtaaacacctaccttggcctccctaagtgctaggattataggcgtgagccactgtgcccatcttatttatttttttgagatggagtttcgctcttgttgcctaggctgcagtgcaatggcgcgttctcggctcactgcagcctccgcctccttggttcaagcaattctcctgcctcagctttccgagtagctgggattaccagcacccgagaccagcccagctagtttttgcatttttagtggagacggggtttcaccatgttggccaggctggtcttgaactcctgacctcaggtgatccacccacctcggcctcccaaagtgctgggattacaggcgtgagccactgcgcctggcctaaatgtatttaaaaagagttttcttgtcaggtaaaagaaaaaaattgtaaataatttattagtcttaacatactataatttttttttactttataaactaatacttagtttaaaacacacattgtgcagacataaaaaaatatttttgttgtttttttctgagactacgtctcactgtgtggcccaagctggagtgcaatggtgtgattgtggctcactgcaacctctgcctcccgggttcgagtgattctcctgcttcagcctcccgagtagccacctcacctggctaatttttgtatttttagtagagatggggttttgccgtgttgaccaggctggtctcgaactcctgacctgaggtgatctgcctgctttggcctcccaaagtgctgggattacaggtgtgagccaccgcgcctgaccacaaaaatatttttgtattcttatttgataagcttttttctgtttgtaaaattattatttttttctttttaaactttttttgtttaaaaactaagactgaaacacacactagcctagccctacatagggtcaggaccagcagtatcactgtcttctacctccacatcttgttccactccaaagttcttaggggaagtaacgtgcatggagctgtcacctccggtgataacggcttcttctggatacttcctgaaggacctacctggggctgttgtatagttaactttttaaaaataagtagaagcagtatactctaaattaacgataaaatgtatagtgctgccgggcgtggtggctcacgcctgtaatcccagcactttgggaggccaggcgggtggatcacctgaggtcaggagtttgagaccagcctggccaacatggtgaaaccctgtctctactaaaaatgcaaaaaattagccaggcatggtagcacacgcctgtaatcccagctactcgggaggctgaggcaggagaattgcttgaacccaggaggcagaggttgtagtgagccgagaccgtgccactgcactccagcctgggtgatggagtgagactttgtctcaaaaaaaaaaagtatagtgcagtgaatacataaccagtaactgtcatttattattattaagtattacatattgtacgcgatcgtatgtgctgtactttcatacggctgttcgcgtagtaggttcgttgacaccagcatcaccccagactcatgagtaattcattgcactatgacatcacaatggctaggaataggaatttttcagctccatcataatcttaacgggaccctcatatatgcggcccatcattgacttgaaacgacgtgaattttgttagccgggcatggtggtgcccagctgtaggttagccgggcgtggtgacgcacagctgtaggttagctgggcctggcacagctaggttagctgggtgtggtggtgcgcagctgtaatcccagctactcgtgagactgaggttggaggatcacttgggcccaagaggtggaggctatagggagccgagatcacaccggtgcactccagcccaggcaacagaaggggagaccctgtctcaggtcgataggtagataagatagccgggcatggtggcacacacttgtagtcccaactgagtaagacactgtctcaaaaaaaaaaaaaaagagaaaaatagccagatgttgtggcaagggcctctagtcctagctacttgggaggccgaggtgggaggatcacttgaccctcggaggttgaggctgctgtggactgtgattgcactattgcactcaagtctgggcagcagagcaaaacctcgactcgaaaaaaaaagaaaagatggctgatatgtagaggggtaacctgtggaagcctggctgcacatggacaaaatttcttgtgattgaataaaaatgttctaataatgtgtgtcagggcacatgacttgtcgtactgcttgatagttgttgcggctctaatataggaacaagtcagaccatgaagttggtggcttgttgttcccgagtctttgcaccgggtgctgctcttctgcttctcctgcagagcatgtgcacagacctggctctaggtcgtcatgcctcaggctagaggaggggccaggctccttcttgctgagaactttagcagagctctggaggagaccctcctgggactgcgctactggagcacatccttatcgcacatgagatggtctctagctctgatccttctcaccacacacttcagcccatccaggtttgactttagtgactgggtgcctcagcactcactcctgttcctgtctcctcttacagatggtaacgaactcgttgaaacatgtccccagaagtaatatttattttccatggatcttttatcttgttctctcttaaaagttgtttttcaggctatgccttttcttgttgacacaaatctacctgttaattattgagtgctgaaaaacacacattttttgggggcaggttcttgctctgtcgcccagctggagtgcagtggcaccatcttggctcactgcaacctccacctcccaggtttaagcgattctcctgcctcagccttaggagtagctgggattacagatgcctgccaccacacctggctgatttttgtattttttgtacagatggggtttccacatgttggttaggctggtctcgaactcctgacctcagcttatccacctgcctcagcctcctaaagtgctgggattacaggtgtaagccaccgtgcccggccttggccttcgtgatttctgatgagaagtcagctgttaacagttatccagtcgcttatctcttgctgctgtcaagattctctctttttttgtcttttggctttcaacactgattaaaatgtgtttcattttgggtcctgtgagtttatcctacttggagtttgttgagcttcttggatttgtaaaatttttgtctttcattaaactcgaaaaggttttggccattattttttcagacattctttctgcccatttcaaacttccatggttggttggtgagctgacatctcacaggtcctttaggctctgctcgtcttctttgttctttctcctttctgaggagacttgcgggagcagaatctcagtcttcccatcttcaagtttcctgattcttcttgtgcctgctcagatgtgctattgaactgctagcatgagcttttcatgtttgtcattgtaccttttaaaagctccaggatttctgttttgttcctttttatgctgtctctgtcgatagtcctgtttggttcacacacacgttgttttccttatctcttttagttgtgtgtttttgtttttgttttttttttgagatggagtttcacttttgttgcccaggctggagtgcagtggcgcgatctgggctcactgaaacctcttctggttcaagcgattctcccgcctcagcctcccgagtagctgggattacaggcatgcgccaccatgcccaggtaattttgtatatttagtggagatggggtttctccatgttggtcaggcgggtctggaactcctaacctcaggtgatccgcctgtctcagcctcccgaagtgctgggattataggtgtgaaccaccgtgcctggcattttttttgtatttttagtagagatggggtttcaccgtgttggccaggctggtctcaaactcctcacctcaggtgatctgcccatctcggcctccccaagtgctgggattacaggtgtgagctacggtgcccggcctgtgtttttatttaagtttttgagcatatttaaggcagttgtttcaaagtctttgtctagcaaatccagcatctggccttccccagaatagtttctgtcagtttttatttctttgactgagtcatactttcctgtttctttgtgtgccttgtgatttttgttgttgttgcaaactggacctgtgatgatgagaacgcagtagctctggaaatcagattcttctcctttccttgggtttggtggggttttttgcttgccaaaggatataggggcccttttatttaacgacttttccaagctattgttattgcagactatcttccttcgttatgtagtcactgaagtccttgttcctcagcttgtgtttagttggtgttttgacaaagatttccttgaatgccaggaactcttacagtctttacgaactggctctgtgcctgagccctccttgaactcttgatgggcttgcccttggcctagggatcagcccagagtgaaagcaagctcgaggccgaggaggtcttcgcagagggggccttttgccctgggcatgtgtgtagctttctgaattttccagcacacactgaggcctctgaatgtcctgatttcccagaaacacacccaggttttcgccttaggcagtctgttgtatgttgggactgtaatcttctgccccaggcatctgagagttaaatgggtttgaaatgtttttaagctttttttggccttggatctgacttaggcaaaacagaagaggagtgccttgtgtcagtcagactccagacacattagaacagacacacacaatacattttgaatgaggtctccagcagcttctggtaggcacttaaggttagaaaacattgtttaggaaaagaatagaatataaagcttagcggttggttgtagaaggttcttgctgctggatccactcagctcctgggcagttggtgggggccagcctccagctgaccagtgagtgggatgctgggctggagctgctggtattatgttaggaaggttattcctgagaaattcagatacttgttgactgaattggtatgatgcttatagtctttcttaaatgattaaagtttaacatattattaaatttaaaaatattgtgaaataatacttcttgtagaacatttagaccgtaaaagtggatgtgaaaaattatccattgccgggcgggcacggtggctcacgcctgaaatcccagcactttgggaggctgaggtgggcggatcatgaggtcaggagtttgagaccagcctggccagcatacaaaaaattaaccgggcatggtggtgtgtgcctgtaatcagctattcaggaggctaaggcaggagaattgcctgaacctgggaagtggaagttgcagtgagctgagatcatgccactgcactccggcctgggcgacaagagtgagactccatctcaaaaaaaaaaaaaaaaaaaaaaaggccaggcacacggtggcttatgcctgtttgccaacacttttggaggccgaggcgggcaggtcacgaggtcaagagattgagaccatcctggccaacatggaaaccccatctctactgaaaataaaaaaattagccgggcgtggtggtacacgcctgtaatcccagctactctggaagctgaggcaggagaaccccttgaacctgggaggtggaggttatagtgagctgagattgcaccactgcactccagcctggcaatggagactctgtctccaaaaaaaaaaaaaaaaaaatccgtggccaggcacagtggctctcacctgtaatcccagcacttctggaggctgaggcaggtggattgcttgaggtcaggagttcgagactagcttggccaacatggtgaaaccctgtctctacaaaaatacaaaaattagctgggcatgatggtcggtgcctgtaatcccagctacttgggaggctgagacaggagaatcgtttgaacccaagaggcagaggttgcagtgagccgagatcgtgccattgcactccagcctgggcgactgagcaagactccgtctgaaaaaagaaaaaaaagatataggccgggtgggaggtgggaggattgctggaggccaggagttcgagaccagcctggccaacatagtgagacttctttctctacaaaaaatttaaaaattaggtgtggtcgtgcattcctccagtcctggacacttgggaggctaagatgggaagatcacttgagcccgggaagttgaggctgtagtgagccatgctcgtgccgctgcgctccaacctgggtgacagaccaagatcctgtctccaattaaaacaacattaagctcattttgtcaaaggaaaaattaccgtcctcgcatttgccttcgttgttgcagacagaagaatgcccttgtcctctgctggtggacacagtccccacaggagccgcatggggtttttctgtgtatcatgtatggtgtagaagagcaaaatgctctgcaccgtgttttatagggaatgaaaaagaaccccaccaaacttaggatgcatctttccagccgggcccttcctcaagcccctcactgtcacctctggccccagggcaggcctggggctcaccccttggacaacactgaggcccagcccagagaagggacttgtaccctacgccatacccacagctcacagccactcagcccagcatgggttgccccagccagatctccttccaaaacagttagaagagtattgatgaagagtccttcagaattttgattcttcttcctctcctggtttatcttctggtggaaagaaaaacacgtttggaatgtttaagactgagaggtgatgggatttctttttgaggtagaaaatgtggtatgagaatgggagggagaaatagaaaagtattgaagcttttaaaactgtaaggtggccgggcgtggtggctcaggcctgtcatctcagcactgtaaggtggccgggcgtggtggctcagacccgtaatctcagcactgtaaggtggccgggcgtggtggctcaggcccgtaatctcagcactgtaaggtggccgggcgtggtggctcagacccctaatctcagcactgtaaggtggccgggcgtggtggctcaggcccgtaatctcagcactgtaaggtggccgggcgtggtggctcagacctgtaatctcagcactgtaaggtggctgggcgtggtggctcaggcctgtagtctcaacactttgggaagctgatgcgggaggatcagttgaggacaggagttcgagaccagcctggacaacatagatggaccctgtctctacaaaaaaaatgaaacaattagctctgtatggtggcacatgcctgtgattccagctactttggaggctgaggtgggaggattgcttgaacccaggaagtcaaggctgtagtgagccatgatcataccactgcactccagtctgggtaacactcgagaccttgttttaaaaaaaaaaattaattaaaaaatatatgtaaatgggccgggcatggtggctcacgcctgtaatctcaacactttgggaggctgaggtgactggatcacctgaggtcaggagttcgagaccaggctggccaacatggtgaaaccctgtctccgttaaaaatacaaaaaattagctgggcatggtggcaggcacctgtaatcccagctactcaagaggcagaggcaggagaatctcttaaacctgggaggtggaggttgcagtgagctgggatcatgccactgcactccagcctgggtgacacagcgagactccatctcaaaaaaaaaaaaatatcgataattgaaagagcttgttggacgcggtggctcacgcctgtaatctcagcactttgggaggccaaggaaggcggatcacctgaggtcgggagttcaagaccagcctggccaatatggtgaaaacctgtctctactaaaaatacaaaaattagccgagtgtgatggcggatgcctgtaatcctggctacttgggaggctgaggcaggagaattgcttgaacctgggaggtggaaattgcggtgagccgaggtcatgccatcgcagtccagcctgggcaacaagagcgaaactgtctcaaaaaaaaaaaaaagagttacctttcagaatgggctcaaccgcttgaatgatttggagaattggaggtaagagattttggtgttaatgactttcacttccctgtcttatgtccattcttcctgcacgattgttgtttgtgggtatgcgtccttctgcacgtaatctgtttgaagcctttccagtgatcccatgtctataccccctttcccctgtgtagccatcccattggcctggatgcttggggatggtttgtctactcatgcccctgtcttttctcctggagttggcacactccagtccagcacccaccctcaggcgtaaccctttccttcctcccacacgcctgcccactggatgctactctgcagctgcctctcctgtaagaccagccgtgaaggttcctgctcagatgctttccctatatctgtctctcagtgccatctagggagggagcaaatagttatcaagttagcagtttattctgtcttgaattctctaattgttttatgcccactaacaaggttgacagctgaggtcccatatcagtaagtgagcatttattatttttttcccagcgcatcacacctgggcttgttgaacagaaaagcctttttatgtgttaatactgtgttggcttgaaatggagtggcaccttcgggggctgacagtggcatagcttggagtgtgatctttctcagacaggggtccacagtgggtgtgtgtggcgtgtggctgctgcttcattgtccttggagtaggccctcccagcggttggagggtgtttgagaccaagcaaattcctgtgtgagcagctccgtcttctctggttctgctgatggattcaccttttagcataggtgtcagtgggccaacctcaggggcgtgcagggacagggacaaagggtgtggtataagcacaagtaggcctgaaatagacaggtttctggagttagaattttaaaatagttgtagattctaaataactaatgatttacagtttttttttttttcagtcagagttgtgctgtatcgcccaggctggagtgcagtggcacgatctcggctcactgcaacctccgtctcctgggttcaagtgattctcgtgcctcagcctcccaagtagctgggattacaggcgcccgccatcacgcccggctaatttttgtatttttagtagagacggggtttaaccatgttggccaaggctggtctcgaactcctgacctcctgcctcagcctcccaaagtgctgggattgcagatgtgagtcaccacgcctggccaaatttttaaatgtattaacttgtatctgtgtattacaaattgatacttgtgtgacaatcagatatgacactcaaatgaaaactgataacttttttttcatacttaacacactgtgaactgcattgtacctgtttcaagaggtaggaagggtgatttttttcttaatagatggagtcttactttgttgcccaggctggagtgcagtggtgcgatcatggctcactgctccctcgaatttctgggctcaagggatcctctttacctcagcctcctgagtagtagggactagaggcacaaatcactgcatccagctaattaaatttttttttttttttgagatggagtctcattcggtttcccaggctggagtgcagtgacacaatctcagctcactgcaacctccaccttcccggttcaagtgattcttttgcctcagccaccctagtagctgggattacaggcatgcaccaccacgcctggctatgtttgtattttttggtagagacagggtttcgccacgttggccagtgtggtcttgaactcctggcctcaagtgatccacttgcctcagcctccctccacaaattttttttttcttctttcttttttttttttttgagacagtttcgttcttgtcgcccaggctggagtgcaatggtgcgatctcggctcactgcaacctccgcctcctgggttcaggcaattctcctgcctcagcctcccgagtagctgggattacaggtgcgcactaccaggcccagctaattctttttgtattgttagtagagacgggatttcaccatgttggccaggctggtctcgaactcctgaactcaggtgatccgcccgtctctggcctcccaaagtgctgggattacagacgtgagccaccatgcccttccccagttttttattttattttattttatacagacagggtgtcactgtcctgctcaggttggtgtagttagtactcctgggctcaagcaatcttcctgccttggcctcccaaccgtgaattactgggattacaggtgtgagctgccacacccggcagaagggcagttttggtgttgataggagaaacagcagaggaccctgctggcaggagaggacaggtgcagagtgcggccaaagcagtattaccaagggcttggtcagctttaaaagtagtctctgggctggatgcagtggctcatgcccagtactttgggagactgaggcaggaggatcagttgaggacaggagttcgagaccagtctaaggaacatagtaggaccctgtctgtacaaaaaataaaaaaaattagctgggtgtggtggtgcgcacctgtagtcccaggtactcaggaggctgatgtgagagaattgcttgagcccaggaggttgaggctgcagtgagccgtgattgcagagtgaaaccctgtataaatgaataaacgaatgaatggtccctggtacttaacaggttatttacctggaaaggaaaagtagaataagttaaacttcttcagtgctgttgccagagtggccagtgggtcctcagcagaggacatttcccacgtgggggtttcgtttgatactgtgatttttgtcttaaaactgttatctaaatccacaactatttttaaatgcttagtaaataaaactggacatgctatcagaatattttgagataccttttttattgtgttgtgttgttttagagatagggccttgctctggtacccaggctggaagtgtcagtggtgcagtcatagctcactgcagcctggaactcccgggctcatgttatccggggaggccgtaggtgagaacttctggcatctaaatgaaggcttcttttaaggggcagactgatagctcagtgttgtgtgagcacctgctgtgggggtgccacacccaggagctgagcagaggtccaccacagctgcccacttggagcccagagcttttgcctcttctggcagcttctctttgcttgtttgaatagttctgggctctgctctgagaatggtcatgagaaaccggagcagtaggaaggccatgatagggaagagtctttcttttatttttattttttagtgagacagggtcttgctagagtgcagtggtgtgatcatggctcactgcagccttgaactcctggcctcaagtgatcctgctgctgcagcctcctaagtagctgggactacacgccagcatgcttagcttttttttttttttttttttgagacggagtcttcttctgtcacccaggctggagtgcagtggcgcaatcttggctcattgcaagctccgcctcccgggttcatgccattctcctgcctcagcctcccgagcagctgggactacaggcacccgccaccacgcctggctaattttttgtatttttagtagagatggggtttcactgtgttagccaggatggtctcaatctcctgacctcgtgatccgcccgcctcagcctcccaaagtgctcggattacaggcgtgagccaccgtgcccagccaagctttttgttttttttatagacatgaggtctcactatgttgcacaagctggtcttgaactcctgggctcagttgatcctcccacttcggctttccaaagttctgggattataggcgtgagccactgcgcccggccaagcttttactttgaaaattctttggcttttacattttatgccatgtgcatttatcatctgttagtgacaacaacaaaaatacttattgatcatcttctctggacagtagttaaatggatttattcttttttttatgtaagccacctaatcttccccttaaattagaatatttgtggagaaagtcctagggaaatggcactgtgctggtacagtacacacacacacgccacccaaaaccgtgggcccagagatgctttggaatcagagcagactggattttacaacagtagcacagcgtgtgtactgggtatgatttcttattcccagcactgcgtcatccaacatgtgagcatttctgttgctgaactcatgaatattctcactaagtgggctaattgaagggtataattagttctttctcagtttaggtcagaattggctgccagatgatttcaggtcagattttttggagcttttttgctttctggaattgtggaaaagggattgtggacctttatggggcatagagcgactccaggcaagtcgctgtgggaggggtgtgcagagtgaagtgctggcgggtggccgtcctcagtggctttgggacctggcttccgtccagctctgtgtctgcagtgctactgtctgtccccctttcctcttgggagccagtgctgcccacccaggtcccgggggcgcaccctctccatggtgtgctctgttgctctgcgtttacggagatggaaaaaaataattaaaaaaaaaaaagaattgtcgatctgccccgtctgtcctacttgagcttttctcggacctgtcatctgttcttccttcttccccattgctgctgacctagtggtttctcacttggacttctggaggggtttcttagttggtctccattcctctccactttgtaaaagtatcatctagacacagaaaagtgcacagattctaagtatagctcagtaagaaccactggtacggtctgttctagtgaagacgtgacgtcatcagcatccacctctcccagccagggcctcccactcctcagctcggaattcctatcccgaattctaaaccataaattagttttgtttgcttttgaacttcatatccatgaaattgtacagagtcctttgtaggagacggtgtttgttttttattgaatactgtgtttctgaggttagtccatatttttgcacgtagctattggccattctcattactggaaagtagtaacgtggatatacaacgattcaatattctgctataggtagacatttaaagtaattttatttggggctattatgaataatgctgttgtgaatattcttatagtcttttttttgttgttgttggaaggcttttttttttttttcttttgagacagagtcttgctctgtctcccaggctggagtacagtggcacgatcttggctcactgcaacctctgcgtcccaggttcaagcgattctcctatctcagcctcctgagtggctgggattataggtacgcaccagcacacctggctaatttttgtacttttagtagagacggggtttcaccatgttggccaggctggtctagaactcctgacctcacatgatcgacttgccttggcctcccaaagtgctgggattacaggcgtgagccaccgcgcttggccgatgtgttcagctttcttaccaacatgttggaaagcgctttgtgcagttcatagccatttacactgtgtgagatccagttcagggtgcctcagagctgcctcaacttttgacattttctctcttttttattttaggtattttagcaggtattgtggttttaatttgcatttccctaatgactaatgatgttgaagatccttctatgtgcttacttgctaccaagcatggttggttttttttttttttttttttgagatggagtctcgcttggtcgcccaggctggagtgcagtggtgccatcttggctcacagcaacctccgcctcctgggttcaaacaattctcctgcctcagcctcttgaggagctgggattacaggtgcctgccaccactcccgcctaatttttgtatttttggtagagacgggatttcgccgtgttggccaggctggtctcaaactcctgacctcaggtgatccacctgcctcggcctcccagagtgctgggatcgcaggcatgaaccactgcacccagccagcgtggtatattaaaaatactttcctgcacattaacaaatgttcacctctcggtgcagctcgccttgtaagtgtggtggggaagctaggagtctgagtgcacatgcaggagctcttcgctgcaggtcccgagtggagggagaggtaatctgtagagtgccccaagagtgaagtgctgcgtcccagtgtcaaacagaggtaacacctcgcttttcttttccttttttttaaacggtgacgggggtctcaccatgttgcccaggctggtcttgaactcctgggctcaagtgttcctcccacctcagactcccaagttcagggataataggtgtaagccactgagcccaacctaaaactcgcttttaaataaagaactcaggccgggtgcggtggctcacacctggaatcccagcactttgggaggccgaggcagatggatcacctgaggtcaggggattgagaccatcccgcccaacatggtgaaaccccgtctctactaaaaataccaaaattagtcgggcgtggtggtgggtgcctgtagtcccagctactctggaggctgaggtgggagaatcacttgaacccgggaggtggaggtcacagtgagccgagatggcaccactgcactccaacctgggcgacaggagcaaaaactccatcaaaaaaaaaaaaaaaggaaggagaaagaaagaaagaatacactgatctctcttatagtgtatactgtctattactactgattttaaagctacaaccttaagcatcatactccctgtgtttagaatattcagggtgtagtattgtggttcacattgtagtattgtggttctccattgtggttccccggaagtgatcaaggtgatactttacattcagggtgtccagtctttaggctttcctgggccacattggaaaaagtattgtctacactaacaagagctggtaagctgaaaaaatcacaaaaatcataatgttttaagaaagtttatgaatttgtattgggccacattcaaagccatcctgggctgcatgcagcccacgggccgtgggttggacaagcttgttttaagagtttaggaagaaaaataatacttctggttatttttttcatcctgcttagttgctatttttctgttttacagtgtgcaatactgtaatataatttatacatatattaatatattgttgccagcttatttttactttaaacttttttttgaggaatatttcacataaaacaaacttaagggtacctttcaaagagttttgacagctgtatacaccatgtagccgaaatcacaatcaaaataatagatccagatattacccctcaccccaaaccttcctcttgccccttggcagtcagcctcatccccctggagagtcccagacactcaactctgtgcctcccctcccgtagaagtgttttcttccagggtttcataaacatggaatcatgtagaatatactggtgtttggctcgctcttattcacatggtatatttgaggttcatcagtgttacttgtgtgggcagttttcctttgcgattgctgggcggcagctgagtggattctcttctatggatgtacccccatttgtggatccattcacctacggctgactgtctagacagtgtccagtctgggctgctgtgcatcacgctgctgtgaacgtctgtgtaggagtcacatttgtgtgaactggtgctctcacttctcttggcagataactacaagtacgagtggtggggccaggtggtcagtgtgcatttatttcacagaaaagctgacccacttttccagagcagttgcaccagtttgtattcttgctggcagtatgtgacagctagttgctccatatccttgtcagcacttggttttgtcagtcttcttatattagccattatctgggtgtgtagtggtatgtcagtatgtgtatttttttttaatactttggatcatttacatcaaccgtggtttaatttgccttgctgttgagcatctctacatgtgcttttggccatttctatgtcatctgtagtgaatgaccatttttaatgggttgtttaccttcttactgaatattaagctttgtttatataccctgaacagaagtcctttgtgagataggtgtattgtgaatattttctcccattccatcctttgccctgtttgttgatactgtatttcatatattcaaatattgatttctacttaatttttcacttagaggtgtacagtcaaaagcatttggaggctactgctcagctgaattagcagaaggaattgctgtggactgaatagaggaaggaaaggacccaggcgctgtcccacagcctctcccgtgacctcaccctgggggaggcatgggtgtttggcagagagccctttttggttttacgtgaatgtcatttgggcgggtgtggggtagaatgatctcaagagcattctcacctccgaggagcggttgcgtctcgatgcatcggcacaggagggctgtgcactttccactgccaccacccgtgagacctccagagagcctgaccctgccatctgcactaagatccccagctgttgtctggtgatccagatgagaggaccagcgtgatagtttctcacagcagcctctggcaggacctggagtggaaatcttccttagtctaaaacacatcccgaatgactgaacattataggagaatgtgtctttgttttacgaggccacttgaagtccacctccctcctcttctgggtgtggcccttgcctgtagctccgagtgtgaggatcttaagtgtgagggtgtgtgctcctgagccagcctttaccccaacaccaagttgccacaccgaactgcagacctggcagccctgtccagcaacttccttatcacagttacagtgcagcaaatgggagaggggccaaaacccccaaaattattctccttattacagttacagtacagcaaatgggagaggggggccaaacccccaaaattattctccttattacagttacagtacagcaaatgggagaggggccaaaacccccaaaattattctccttattacagttacagtgcagcaaatgggagaggggggccaaaaccccaaaattattctccttattacagttgcagtgcagcaaatgggagatggggggcaaaaccccccaaattactctccttattacagttgcagtgcagcaaatgggagatgggggccaaaaccccccaaattactctccaagccaaaggaaaactctggatgctcgatagccacttacagagctgctcatcacatgcgttgttggaacacctaacactagcctcctggttatgaatgtttctggaatcgagcctccctgatatgtgcctacagaagcggatctgcctgaggacatccgccatttcctaatatttataccttagaatatagagccagcttcataacatgtggggtccagtgcagaatgaaaacatgggacctgtagttgagaaagcaggaaaaggccgggcccagtggctcatgcctgtaatgccagcactttgggagattgaggtgggtgcatcacttgagcccaggaatttgagaccagcttcagaaatacagtgagacccccatctctacaaaaacaaaacaggcaggtgtggtggtacgtgcctgtagtcccagctattcaggaggctgaggcgggaggattgcttcagcctgggcttgcagtgagccatgattgtgccactgccttccagcctgggcgacactgcaagaccttgtctctaaacaaacacacacacacacacacaaagagcttctttatgtcttctgtggattcctggcctgccatagtgtttttaatttgccacttgacttcaagctttcccaggaatacgtgtctgaagcaaggcacccctgttcacaccccaccagggacattggacagttgtgggggaagaagggggtgcaggagcaagatgggctgtgtcccattgaacttcactacagaacaccaatttaaagataaatgattagggatttcaagatgttggcagtaaggcattaaactccatgcctggcccttctgaggcgggcttttttttttttttttttgagatggagtcttgctctgtcccccaggcgggagtgcagtggcgcaatctcggctcactacaagctccgcctcccgggttcacgccattctcctgcctcagcctcccgagtagctgggactacaggcgcccgccaccacgcccggctaatttttgttgtattttttaatagagacagggtttcaccatgttagccaggatggtctcgatcttctgaccttgtgatccgcctgcctcagcctcccaaagtgctgggatgacaggtgtgggccacggcgccggccctgaggtgggctttgtgcagctgtgctggccacacaagcctgaaaccggccttgtctgtatggaaaagttctgtgtcaaaactaggtggtttctaagtcactgtgaagcactgcgtgcagtaagcgtgcgtcactgaaagatgacacttgcaagccagtactgagccgggtcgttaggtgtcaaagcctgttttaagcttcggaggcttaggttagaagatttgtgctgaaaggccggaagtggtggctcacgcctgtcatcccagcactttgggaggccgaggcgggcggatcacaagctcaggagactgagaccatcctggctaacacggtgaaaccccgtctctactaaaaatccaaaaaattagccgggcgtggtggcgggcacctgtagtcctagctactcgggaggctgaggcaggagaatggcgtgaacctgggaggcggagtttgcagtgagcttagattgcacctctgcactccagcctgggcgatagagcgagactccatctcaaaaaaaaaaattaaaaaaaaaataaaaataaacatgatggcatgtcatgagttttgaaggataagaagttaaagctggccaggcacggtggctcatgcctgcaatcccagcactttgggaggtcaaggcgggtggatcacctgaggtcaggagtttgagaccagcctggccatcatggtgaaaccctgtctgtactaaaaaaaattacaaaaaattagccaggtgtggggacatgtgcttgtagtcttagctacttgggaaactgaggcaggagactcacttgaacttgagagatggaggttgcaatgagctgagatcacgccactgcattccagcctgggcaacagagcgagtctatctaaaaaataaaaataaaaaacataaaaatttgaggctgaggtgatagttgctgcttgaggtttattgctgatgacaaagtgtgggctatttagggtttctaatgtatttctcattgtcttaaacggtcttcagctctgtcaagctgtttatttgtaatttatgtgctttaagatgacacttgccactcagacctcctccaaggaggggcaggggagcccattcctgggcctggcacggtgctccacctcctgcacacccctttctggggcaggtccttggactgtggggaagcacctgctgcactctgggtggtggcagccttgggccctgggctcccccttgtggagtcctcagggtgtgaggcaccataaaattattcaaaaaatgaagtggcttccaaacactctccatgtccgcactcccctcgcggtggaccaaggcacacgctcccagcctggccacaggcctagactagtgttgaggtttgcattggacatgttgaaggcttacaaatgtttttctttttcttttgaaattacttcagaattaaagcaaaattgcaaaaatagtacagagaacttccgttttcccagattcccactccgttagtgtttcaccaaacccgcatgttcagtctctctccctctccttaaacattcgaggggcagttgcaaaggtgacgctttccctgcaggcatcctcttctgtgcctgccctggtgagaactgctatggcaactgtgtcctaatggccgaccttctccaggcttcacccaccgtcgctcctgcccttcactgataggccctgtgtcacactgaaccctcctgtcgctttaatcctcttctatgtgtggccatcctcagcctttgtcttctgtgacattgatatttttgaagagcacagcattagtgatttcgtcgaacgtccctcagttaggatttgttggatgtttcctcttgattagatctaggttagttacctttggcaggaactctagaggtgaagttgtgtcctctcagggcaccatggccgtgttaccctggtgtcgttttgtgccgtggacaatgatgctggctgtgagcacttggctgaggtggttgaagagcagcatcccaaacagggctctggagtgcagagtgacctctgcagccactctgctcaagcgtctccgcgtgctctgcaaggctccaaaccggagaggtgctctgtaggtcaccccgttacgtaaaatcacagactggaaagagtttgttagattttctttcttttttatttttggagacagtcttgctctgttgccgaggctgcagtgcagtgacatgatctcggctcattgcaacctctgcctcctgagttcaagcgattctcctgcctcagcctccggagtagctgggattacagtcacgcgccaccacacctggctgatttttgtatttttagtagagatggggtttcactatgttggccaggctgatctcgaactcctgagctcaggtgatctgcctgccaaggcctcccaaagtgctgggattacaggcgtgagccaccgtgcccagccagacttgttttttaaacaggcagaaaggagctcacccatggagcattttttctgagtcgcctgagttatctgtgtcacggcagaaaaggacgtcaggagtctgggggaagcagggccatcctggaggccacagcccaggcaggtgccaaggccaaaggcagctcttctgtgcttgcctctcagagtgggactgcctgggaccagacctgctgctcctgagctgtgttggccctggccttgtctcctctgcatgtcaaggacacatgacctgcttgaatggcaggggcttttgttatgcaggttcccagccatgccgtcactccacagaagcacaaacatggttttcggggactttggatgtttctggaggggtctgactctgggtctgtgttcatgagatccacattcacaggcgtggctgcgaagaggcccctagaccttgggatgtgtgctgagcccttaagacatgaaccaccactagaatcggctaagctccagggacacagcagttgcgcctgtggtggagattgtcccagacggacgtttgtcccgttgctgtgacgcagatggtggatgggctgtggggctgctttcaagtacttttttttttatttcccgagatggagtcttgctctgttgccaggctggagggcagtggcgtgatctcagctcactgcagtctccgcctcccaggttcatgccattctcctgcctcagtctcccgagtatttgggactacaggcgcccaccaccacgcctgggtaatttttgtatttttagtagagatggggtttcaccatgttagccaggatggtctcgaactcctgagcttgtgatccgcccacctcggcctcccaaagtgctgggattacaggcgtgagccaccggacgtggcctcaagtacttttttgaaactggttgtagggaatagtttgacaaatcggctagttggttgaacttgctttgcataaagagacatcactaaatataactctccttaaagttggggacttatttaaatctgattcatttctgtggggctgtatgatgttggttaatactgaagtcttgcaacaaagtctggctttgttcctaaggaacctgtctttggagtccttagagcttcttcgtgagtctgttaattcataaactccagaccattggcctgcacgttgcatttgtaataatttccattcccacaagaaactagaacaggagaatgagagagccaggctgggagaaggatgtttgcgacactgaatccagtttaagttgttggtttgttcaagtgaaggaaatggaatttttatcagggccctctgaacaggtttgaaactttacttagggatttgccattctgctttctgccacctagtgttcctttcctgtagtgcatctcttaacctgtcccttccttccatttttggtcagacgtctcaggcttgtaaacagattcctagtctatactgagcttcattacaaatcttgcagaatccagtgaggttttttttttttttctttttttccaagacagagtctcgctctgtcgcccaggctggagtgcagtggctcgatctgggctcactgcaacctccgcctcccacgttcaagcaattcttcctgcctcagcctcccaagtagctgggattacaggtgtgggccaccatgcccgactaattttttttttgtttttaatagtggcagcgtttcaccatattggccaggctgggttcgaactcctgacctcaggtgatctgcccgcctcggcctcccaaagtgctgggattacaggcgtgagccactgctcccagccccaaataaagtacttttaggaacacacagtgccaggaattgggataggctgactgtatgagacagccccctcatcagcctagtgtcttccagacacttaaactccatcattgaccccaagtgcttctgtggaggaaagttgcagggccagggaagaggcacctcaggccttgggaagtcaggggcccttctagccaagacaccagctgcatgtggacctgcactgagctcattgccctgcagccatgtggggaagacacaggtcccaggaggatctaacccccggcatctggtttcgcccccacctccgttctgttgtaatattttgcggctctttttagtgtcatgaggcaactcatccaaaattattccacagtttttaatttctagttttgaaaaggggaacaaggatttccaaggtaactgaactccatagagaacctgaaaacagttttaatgtatcttgtttcgaatgtaacctacattcaaataaattataattatagtgtgggtgtccatgcagtcacaacccaggtaaaagaaataggtcactgtcaccgggcgcggtggctcacgcctgtaatcccagcactttgggaggctgaggcgggcggatcacaaggtcaggagatcgagaccatcctggctaacatggtgaaaccccgtctctactaaaaatacaaaaaaaaaaaaaaattggcgtgggggcgggcgcctgtagtcccagctactcgggaggctgaggcaggagaatggcgtgaacctgggaggcggagcttgcagtgagccgagattgtgccactgcactccagcctgggcgaaagcaagactctatcacaaaaaaaaaaaaaaaaaaaaaaaaaaaaaaagaaataggtcatggtcagcacaaaagcatagaaaatggcacagtgaacccccacgcctgtcatatgatccacattttgctcatttctacatccatctgcatggacggcttttatttttttaaactgtctattgaagtatactgtctatacagaaaagtgtgtgtatcgtgcgtatgcaactgatgcatttttacacacaggaactctcactgacgcagtcagaatctagatgaagaaaaagcaagttggccgggcacggtggctcacgcctgtaatcccagcactttgggaggccgaggtgggcggatcatgaggtcaggagattgagaccatcctggacaacatggtgaaaccccatctctactaaaaatacaaaaattagcagggcatggtggcgggcgcctgtaatcccagctactcaggagactgaggcaggaggatcgcttgaaccagggagtcgaaggttgcagtgagccaagattgttccattgcactccagtctgggcaatagagtgagactccgtctaaaaaaaaaaaaagcaagttaccaggacatctggatagcttttaaatgtattccatggctcatcaacgtggagaggctcacacttagatgaaaacacagagcacctccctcaccttgctggggctggggctggggctggggctggggctgggcttgttctgtggcagccaggatggaggacgaacagcacatccccatgcttttggtcaggctgtgagcagatggccagcagcaccttcctgcctcttttttttatttttatttttatttttttttgagacggagtctttgtcacccaggctagagtgcagtggcaggatcttggttcactgcagcctccacctcctgggttcaagcgattcttcagcctcagcctcagcctcctgagtaattgggattacaggcacgtgtcaccacacctggctaatttttgtatttttagtagagtcagggtctcaccatgttggccaggctagtcttgaactcctgacctcaggtgatccacctgcttcggcctcccaaagtgctgggatgacaggcgtgagccaccgtgtccagcctctcttttatttttattttattattattattttttattttttttttgagacagagttgctcttgttgcccaggctggagtgcaatggtgtgatgatctcagctcactgcaacctccacctcccaggctcaagcaattctcctgcctcagcctcccaagtagctgggattacaggcaggtaccaccacgcctggctaattttgtatttttaatagagatggggtttctccatgttggtcaggctggtctcgaactcctgacctcaggtgatccttccgcctcagcctcccaaagtgctgggattacaggcgtgagccaccgtgcctggcctatttttattttttatatatatatatttttgagacagaatctcacactgtcacccaggctggagtgcagtggcacaatctcagttcactgcaacctccgctccccaggttcaagcgattctcgtgcctcagcctcccaagtagctgggattacatgcgcgtgccaccatgcctggctgatttttgtatttttagtagacatggtgtttcaccgtgttggccaggctggtcttgaactcctgacctctggtgatccacctgccttggcctccaaaagtgctgaggattacaggtgtgagccactgtgtccggcctctgccttttttaaaaaaactagaaatgggatcttgctctgttgtccaggctagagtgcagtggtatgatcacagctcactgcagcctcaaactcccagggtcaagcaatcctcctgcctcagcctctgagtcactggaactacaggtgtgcaccaccatcctgggtaagtttttaaacattttttgtagatatgtgggggtcttgctatgttactgatgctggtcttgaactcctgggctcaagtgatcttcctgctttggcctccctcaatgccgggattacaggtgtgagcaaccgcgtctggcccctttcctcattttaaatgccctgtgctcctgaggatcctctgcagtggaatgtcctcacagcactaattgtctgttgtctttaattggaaacattggggttgggtacagtggcccatgcctgtgcttccagtactttgggaggccaagacgggaggatcacttgagcccaggagtttgtgaccagcctgggtgacattgggagaccttgtctctacaaaaaatgataataataaaaattagctgaacatggtggcgtgtgcctgtagtcctagctgctcgaggctgagacaggaggatcccttgagcctgggaagttgaggctgcagtgagctgtgattgcgttgctgcactccaacctgggctacggagcgagaccctgcctgaaaacgaaaaggaaacagaaccgatgcaagggaaggatggctcagtgtggcagtgccctgtccgcggagagcactcagccgggtctggacgaggacgttgtgcgtaactctacggagaagtacgagctcacagataatatgggggtgtggtcctgttgtgtgagaagcagacgaaacactaagaggacattgggttccccatcattccagggctactgcccccacaggggaggaagagatcgcctctttccctgttggaattgtgcacactgctggagccctctcctgggaggaccggcggggagtctgttctgctggtcaaggctgggctttctgcagaagttcagggtggacatggaataaatatagcacagtggacaccagatgtgtctgtgggaagaagtcactgttcacatctttacatctttttttttttgagagctctgtcgcccaggctggagtgcagtggcgtgatctcggctcactgcaagctccgcctcctgggttcatgccattctcctgcctcagcctcccgagtagctgggactgcaggtgcctgccaccacgcctggctagttttttgtgtttttttcagtagagacggggtttcaccgtgttatccaggatggtctcgatctcctgacctcgtgatctgcccaacttggtctcccagagtgctggaattacaggtgtgagccactgcgcctggcccacgctggttaatttttatgtttttagtagcaatggggtttcaccgtgttggtcaggctggtctcgaacttctgacctcaggggatcctcctgcctcggcctcccaaagtgctgggatgacaggcgtgagctactgagcctggcttagtagtacagtgtttgatttggtgtcctgagtgtctgtatgtggatgtggagtgcggttttccactgagcttcagtctgaggttgcgcggttggtgctcgctgttcttcccatctctgctactggctggcgaccgtgcggactccacagctgcgctcagctcagagccagcttcgtgtgcagagcccagcagagatggcggagccacttggcatccaagcaccttgccctgtttgtgtccacctggttctgccgtgagaacccctgggttttaagccgttaggctggtatgagagggtgggtggtcctgggaacacgtccccacgtgggacgggctgctcattagcagtgaggaggactcaggagatgatgggtgggagtctagggtggctttcagatcctgctggaacctcgtgccaggctggtcttccttgttgtcctcagaggaggtgacagctgtacacacacaccaccccccacccaccccccttgtttgcagactctagaagtaatgtctgttgaaagggagctaagctcagtcggatctcagatacatggcaggtgatcagttttattatttattatgtatttatttagagcagcactgaaagcttattaaaaagctttagagcaggaaggaaaagaggtaaagtacacctggaagagggccaagtgggtgacttgagagattaagtgccggttttcttctaaaatgtagtgataaacaggtgtttgcatctggaaagtctaaagccagcagtgaatgccactgaatgtgaagtgttgcagatctttgctctggatagacttttttttttttttttttttttttaatggagtctcgctctgtcgccctggctggagtgcagtggcaggatctcggctcgctgcagcctctgcctcccgggttcaagagattctcctgccttagcctcccgagtagctgggattacacgtgtgtgccaccatgcctggcttatttttttttgtatttttagtagagatggggtttcagagtgttaggcaggatggtctcgatctcctgacctcatgatctgcctgcctcggcctcccaaagtcctggaattacaggcatgaaccactgcgcccggcccttctcgctgttatttaagggaagcggtctcactgtgtggcacaggctggtctcaaactatcctcctgtttggcttcccaaagtgctaggattacaggagtgggccaccgtgcccggccctcctcgctgttatttaagggaagcggtctcactgtgtggcgcaggctggctttgagctcctgggctccggcggttccaccctggcgctgtggtgcagctggaagcattttgctgtcttttgtttgactgattctttttatttttcctttgtttccattggtttcgataccagtggtctgcttctctcttggtcttcgttgattcagttaataatttgcaaggatgtaaaataaaatagagctttatagaccaaaagatcgttgtcttaaatatatcatttatagacgagatcaggcatggtggttcacgcctgtaatttcagcacttttggagactgaggtgggtggatcacttgagcccaggagtttgagaccagcctgggaaacagcctggcatggtggcatgcgcctctagtcccagctactcaggaagttgatgcggaggatcgcttgagcctgtgagttcgaggctgcagtgggtcagtgatcgtgccactgctctccagcctgggtcataggggtctttgttggccaggctagtctcaaattcctgcactcaagcaatcctccctccccagcctcccaaagtgctaggattacagatgtgagtcactgcccagccttcagacgttttctcctgaaggtgaacaagcaaagaaggtggcttactttttcagtgtcttaacaggggttttggcagagaagctttttcagttttcatgatgggcgcgttttgaaggccagagctgatggcactggtggatggactcctgtattctggcctgagcacctgagtgctgcctgtcactgctgaggggagtcctgggagaggagcgtgggctgggagtcttgtttgagacccccagtgttgatgcatatgaggggccagagtgtagggagaccctggagctggaagtggggattttggagccatttgggtatatgtgtagagttcaaggtctgaggcctggatgagccaggagtgagggtagagggagaaactggagtcgaggcctggagcattgaaccttgaacatcgggcggtaaagagaggaggctccggtaaggggttggaaaggagtgctgcaaagtgggaaccagagtctggtgtcctggacatccaggaggtggccactctgtgagggtctgctctgtacaccaagaccgtggggaggactggccgtcctgcgtgtgcctcacggggaaaggagaagggcgaggggaggcagcggcagcacggcaaagaagcgagtgttgaaacccctcaggtgctgtccttcccgaccccggctagagggttgggaagtgtcttcttggagacgtccctgaagcgggagggccatggcgtagcttccgacctccacaggctggacccttcttgggcaggtgcctgaagcgggagggccatggcgtagcctccgacctccacaggctggaggtgcccctagggcagggtggtggacagagtcttcctctgttggggggggggggtgcccgcactgggcgcacagatgtgagccgggctgagtcccgcgccgggtgcgcggatgtgtgctgggctgagtgtggccggccacttgtttgcgttgtttgtggacatacaaataggctgttgttgaactgggttcgtggtggggacttagagactctcagagtctatggctatttttaaattttattctttgaaggtatttggcttgcatgacctttgtttggttatgttttacttgaatcatgtcaaggaagctacatgaagtgtgaaccagagtgttcactgcaaaccttctcccctgtagcttaatgtccctggctctttgtttgccagagccaacagtgaaaagggtgataggattttttatttaaagaaaaggaggctgggcgccatggctcacgcctgtaatcccagcactttgggaagccgaggtgggcggatcacgtgaggtcgcgagttcgagaccagcccgaccaacatggagaaaccccgtctctgctaaaaatacgaaattagccgggcgtggtagtgcatgcctgtaatcccagctactcaggaggctgaggcaggagaatcgcttgaacctgggaggtggaggttgcaatgagcagagatagcaccattgcactccattctgggcgacaagaacgaaactctgtttctaaaaaaaaaaaggaaaggaattatttttcttaaataagaaaactaccacaaagttattgctttgtgacccagatacatttgtatgtttgttttgaaaggaaaaatagacactgggtggtatttgagttttgttttaagtctactataagacccaaaacatattcaggcacttagtttaaaagcagtcatgtaaactaagtagtatttgagtctttttgagtctatgctttttttttttttggtcgggggagacagggcctcttgctcagactgaagtgcagtggcactatcatagctcactgcagcctcgaccttctgggctcaagcaatcctcctgcctcagcctcctgagtatctgggaccacaggcatgcaccaccacgcctggctaattttttgtagtctttgtagaggtggggtcttgctgtgttgcccaggctggtcttgacctcctggacccaagtcatcggcctgcctcagcctcccaaagtgctgggattacaagcatgagctacgatacctggccttgtctgtgctttttattttcctgtatggctggtctaagtagcgttttcttactggtgtttttaaagtcatgaagcaccttagttgtggttttgtttgtttggcgacttataataacacggtgagctgagcttggaagtgttgcatccatgttctcagctgctccagtgttgtggggacatgtggggactctgccctgccccggctggaacagcaaaaggtgctgatggtgggcttttcttttccaggtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcaggtgcggccatggggatgggggactggagcatccttagtcccagtggcagccccaagtaacgcctttctccttccctggtgctgacttatgtggagagagagaatgtgaggtggtgtttaaaatatcattggatttctgctctgaatttcctgcattatgaaatgcagttcccaaaggttcctggtttttatttactcattcccttttttttttttttttttgagaaggagtctctgtctgttgcccaggctggagtgcagtggtgctatcttggctcactgcaacctctgcctcccaggttcaagcgattctcctgccttagcctcctgagtagctaggactacaggcgcccaccaccacgcccacctaatttttgcatttttagtagagacagggtttcaccatattggtcaggctggtcttgaactcctgacctcaagtgatccgcccacctcagcctctccaagtgttgggattacaggctgagccactgcacctggcctgtttactcattctttaaaagatgtttttaaagtggtttttttttttttttttgggagatggagttttgcactgttccccaggctggagtgcagtggtgtgatctcggctcactgcaacctctgcctcccaggttcaagtgattctcctgcctcagcctcctgagtagctggggctacagacatgtgccaccatacccggctaattttttgtatttttagtagagacgggatttcactgtgttggccaggctgatctcaaactcctgacctcgtcatccacctcccaaagtgctgggattacaggcgtgagctaccacagctggctggtttttttttgtttgtttgtttgttttgttttttgtttttaagagatggattctggctgtgttgcccaggatgaactcaaactcctggacttaagtgatcctcccgccttgaccttctgagtagctgggacaacagatgtgctccactgtgcctggcctggattctttttattggagtataaatgaaagggcagacagtggtctaaagtctgccctttcaaaattttaattttgaattttttttagagagcccacagcctgaagaaccatgagccaattaaacattttttctttattttttttttaaagaagagtagagagcccagaaataaaccctcacataatgtagtcaaatggttttttttttttttgagatggagtttcaccctttttgcccaggctggagtccaatgtgcggtcttggctcactgcatcctctgtctcccaggttcaagcgattctcaagcctcagtctcctgagtagctgggattacaggcatgcaccaccacgcccggctaattttgtatttttagtagagatggggtttctccatgttggtcagggtggtcttgaaatcctgacctcaggtgatccgcctgcctcggcctcccaaagtgctgggattacaggcgtgagccaccacgcctggcctcatcaaatggtttttgacgagggtgcccacatgcccacaccattcattcagacttcccaacaagtggtaccaggtaaacggtatgtccacatggaaaataatgaatttgggcccttatcttataccgtgtgcaaaaattaactgaaaatggatcaaagacctaaatgtaaggcctgaaactataaaattcttagaagaaaacataggcaaaacctatgacattggatttggtattgatttcttggatttgataccaaaggcacaggcaacaaaagaaaaagacaaattgaacttcttgaaaatttaaaaaatttctgcatcaaaagacaacatcagtagtgaaaaggtgttgtacagaatgggagtaagtatttgcaaatcatacatctgacaagggattaatatccagattatagagagaactcctaaaactcaacaacaaagaaacaaaagacccagttcaaaaacgtgaaagacattgtttcaaagaagatatagaaatggccaataaggacatgaaaagatattcagcatcagtagttattagggaaatgccaatcaaaacacaatgagatcccacctcacacccattggattggctgctattaaaaacaaaaaacccagaaaatagtgttagtgaggatgtggagaaattggaactgttgtgtgctgttgcaaggaatgccaaaccgtgcagctgctgtggaaacagactagcagttcctcacaaaactaaaaatagaattaccatgtgatccagcaaccccacttctggatatagacccaaactgaaggcagggtcttgaagaaatatttgtatgcctgttttcatagcagccttatgcacaatttccagagaatagaagatacaatggaatattattcagccttaaaaaggaaggaaatcctgacatatgctgaaacataaattaaccctgaggacgttatgctcagtgaaataagccagtcattgagattcctagagtatcacatttgcagagacagaaggcagaatggagaggtggccaggggctgggggcggggagggggagccggtgtttcttggggacagagcttcagtttgggaaatgagaacattctggagcggggtggtgtgatggctgcacctctgtgtgaatgcgcttcatgctgctgaagtgtgcagtttaaaatggttaaaatggtaaattttatgttgtgtgtattttaccacaaaaaaaaaaataggccccctggaaaaacatccgttgtgcatgtgtttgtgaaatggaggtgtggccagtggactctggccaccatcctgtgcctggtgctgtctgagagtcgccccggctggcatcagggccttctcgttgctgccctctctcccattgctcctttgctgagaggctgccctctctcttggctgaatttggctgaacataactgagtgggccaaatagtaagtgtgcaagtgggtaggcacaagtcagtcctgccgcccagtgcttattaagcactgcatgaaaagggcacagaattccctggagtagaatgtgcccaagtttacgtaagtcacatacagctcaccgccaagcagcagccttgaagaccccacttcaagtgtgactgacagcagcggtgggtgcaggggaagggtgggtcacagctgccaccctgaggttgggtcggctcccaactccgcctctcctcccacctgctgctttcttttcatcctgcgtttccttgcttgcccctccccacacctgcacagacctttgtcagggggaacccaggtccccggggcctccaggtggagcgagcctgagcaacctgactttccaaacctgccgtccacccagcaggtcactcgccttcctcgggccacactggctgcatcctccacttgttaaaagttggctctttaaactcataaattgtagatgctttttctccagtgctttaaggatggttgctggcattgagtaaatacttgttgaatgggtgagtgagtataccagtggtgcatattcatggcggagagtctaagaagcactgcagagggtacaaggccactcgtgtgttgccctttccctcctcccccccacctctccatctccctggccctccttttggagttgtttctcagaggtcatgcctttaggcttcttggtgattttctctagaccttctctatgcatttgcaatgtttttccccaaacacacctctctgacttataagataatcttaccttgatattgttccatttcaatggctcgttctttttattgaagtgcagaaaatgaggcatggagagaatctgcagctccttgacttaccagaaatgcacgtgccctttaatcggcacagagatcaagaatcagaacactccctgagcccccgtccagcccggtgggaaaaagtggctgtttgaaaacgggcctgattctgtgtcccgggcgcccccagctgacccgctgctgcgtcccgggcgcccccagctgactgctgttgtgccttcagcaggtgtccatgtccacggcttcatcttcagtggaaccgcttgctccacttcagctccaggggccttggctggcagacccctcccctcccccaccaccccgactttccctgtcttttctgtgccccctgtcacagctcctcagtgaggacctctgtgcctatcttgtgtcactttgtgtctttaataagttctggaaccattcggagcctcagtttcctcactggtgaaatgagtgggccactgcctcccctgagagcttgtgtcacatttcatgagctgacgtttatagaagcaaataccctatttccacattgcttcttgggacgatcttaaatttcacagatcatttataagaatctgtgtttccataggaaatgctgatattctcttccttttttttttttttttttttttaacatttctgtatttgttatccctgtaattaaagccagttgctgaagcacagtaggatgcgtgcactgtgatagactaataggaacaactttttctcttccacagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggtaaaggctttgtagccttgaagcagcccctgggggacagtgtgtagccacagggccctcaatgtcacctgcctgtcactcacctgcctgtccagtgacagccctgccagggcatcggtggggatgtgggcttgattctggtgttgctgctgtgttcttggtattggggctttttgcaagtgtactcgtttagtcattcaacgcacatcttagggtctccctaatagctgtaggcccaggtgctgagggctgggcagacagcggaagatggaggagtaccttggtctttgtggagctcatgtgtgtttgtgccggagtttatccccttgtcccaaactctgaaggttatgcaaatgcacaccctgccactcatgtttgtatagggcacgtttgtcacttgtttggacagcagttgttgagagtcacactatgacctggcacgtttgtattctttgacccagtaattttccttttaggactttgaccaaaggaaatggatgaaagtttgtataaaacaatggaatgcggctgggtgtggtggctcatgcctgtaatcccagcactttgggaggccaaggcggggggatcacttgaggtcaggagttggagaccagcctggtcaacatggttaaaccccgcttctaccaaaaaaaaatacaaaaagccaggcgtggtggcacgcagctgtaatctcagctgctctggaggctgaggcgggagaatcacttgaaccccgggaggcggaggttgcagtgagctgagatcacgccactgaactccagcctgggtgagagagtgagctcctgtttcaaaaaaataaaataaaaaataaaaagaacgcaacctcagtgtccctaggggaatggtgattaggatattgtgcttccacttagggaatagcatgcagagtatttgctgatatggaaatattccagatgtaatgctgagtggaagaaagagagtaagaaccatgcatggtattacttgacatattgaggaagtgtgatctatcccagcagaacgcagcacagccatgagaatgaataagccacagctgtgcatcccccacctgcggccgactacggcgtctaacacagggtgctaggcaaggagggcgcgtcgcgtgtggtgctgtttctgtcaggcttacaattggacagatctaagttgtattgtttaaggatgcagccaagtggtaaaacgtagtaaatcccagcaaaactgtggtcactctaagaagtcagtagtaatggtggcctcttggagaagtagaggtagtgggctgagagggcccatacgagcatgttggggatgctggtggtgccctgtctcttgacctagtatactgatgttcactttgcaaaaatttgttcagctgacataaatgtatcatgagcttttctgtctgttttatatgtttttcaatttaaaaagtttttagaaacatagaaaaaaatcacagggaagtcaacagcacaggcacagtgacgaaggctttgttagctgtttaaaggaagagacgtagcgggcagtgtggcatgcacctgtagtcacagctgctcgggaggctgaggcagaatcacttgagttcaaagctgtggtgagctacgatcaatccttgaatagccactgtactctagcctgggcaacatagcaagaccctgtctaaaaagaaagaattaggtatgtggagggtcttcttgtgattacatttttctgtttaaaaaaaaaagcgataggctgggcgcagtggctcacgcctgtaatccccagcactttgggaggccaaggtgggcggatcacgaggtcaggagatcgagaccatcctggctaacacggtgaaatcccgtctgtactaaaaatacaaaaaattagctgggcgtgttggcaggcgcctgtagtcccagctactcgggaggctgaggcaggagaatggcgtgaacccgggaggtggagcttgcagtgagccgaaatcgcgccactgcactccagcctgagtgacagagcgagactctgtctcaaaaaaaaaagagagacaaatttgacttcgggaggccaaggtgggcatatcacttgagctcaggagtttgagatcagattggacaaaaaagcaagatcctgtctctacaaaaataccaaaaattagccaggcatagtggcatgagcttggagtcccagctgctggggcggctgaggtgggaggatcacctgagccctgggagttcaggcttcagtgagccgtgatcacaccactgcactctggcctgggcgacagagtgagaccgtgtccccagaaaagaaaagacaaacgtccctctgcccactctgagctgtcagcgctgaacgcggcctgtgctatggaagcccatgtgggcgcctctgatatccttgcctcctgtctgtcagcctgcctgtttcccattccatttgtgtttatccttgaacagtatctataattgttcattgtaaaactccatgtatatagtatcatcttgaatgtattttttcatccgacattatctgttgctcttcatccatgttgacaagcgtgttgcccagaagttcacaaccaggagtgattccctttcccagtgggctcgtgcctgtaagtgtgggtttcaagttgtcactatgacagggagccaccagtggccttgaaagagccaggaccagggatgccagcctgtcagcggggcactcagcagccaggatgtctccaaccccaaggtgaagcctccatggggctcttcgtgggccagggggctcctcctcatgggcggcagggtctccttgtggatgggtatttggtgagtcccaggggctctgggcagccctggccacccctggtgcttatgcctggggaggggtgctgctggctgtgagccctcagccagccttacccacccctcgcctgtacccctggggtagctgacaggatctggtcgtggttgaggtgctttgccttggactccactgaggtcaagcagcctttatgtcttcatttttgacatttggattttttccttatgtaatttttaatattctttatagttttccatttgtttcctccatgttttcgaattgtattactttcatagtaagaaaaatgaggtatcaggctgggcgcagtggctcacacccgtaatcccagcacgttgggaggccgaggcaggcggatcacctgaggtcaggagtttgagaccggcctggccaacatggtgaaaccccgtctctactaaaaccacaaaaattagccgggcgcggtggcaggcgcctgtgatcccagctactcgggaggctgaggcaggagaaccgcttgaactcagagggcggagactgcagtgagccaagatcgcgtcactgtactccagcctgggcgacacagcgagactctgtctcaaaaaaaagacaaatgaggtatcagaggaacacttaaaagcactgagaatctttaaatctagtaaatttaatacaaaatatggtaacttcaatattcgttttgtgtttgttttttaaatacaggatgattcaaagccgccttactcctacgcgcagctgatagttcaggcgattacgatggctcccgacaaacagctcaccctgaacgggatttatacacacatcactaaaaattatccctactacaggactgcggacaagggctggcaggtaaatgccttcagtttgttgttaaatagaggctgatggataccgagaagaaagtggagcggctgctgtctggaacacaggcacaggataggaaggtagaagggggggttggagcctcccgtgctgagaggaagaggagttgggggccggtgctgccatgctctgcctcaccttctttgtgtggagcagaaggaagcgtggttctggaggagcgtctaggcctgcatgctttactgttgtggaaattcatgtgtctgcataggatttgtgaagtgtggattgtttgagatatttccctttgaccaatgcagttcatatttgaaatgtaggagaaatttaaaacccagcctatccttccctttggcattctcctgtcttcctcatctaatcctgctaatggacagaagttttgaagtttgcagagacagttttcaaaccgcattttaccaaggaacacttagaagacatcttaaccagttggccggggtaaaaaacagatgaacgtggtgtgccctgtctcagccggggagcccacctggtcgtggaaccccggggctacccccaagagacactttgaaatctgcaaaatattccctttggtcagctcacacaccaataatttttttttttttttttgagtcagagtctcgctctgttatgccaataattttaaccctttagattatgtaggttttttctctgtgtatctgtgttgtgttggctgtttactggatgtatatgagaatcttgctatttgaaataatttggcagtgggtaggtttgaaatatagaatattaaaaacatagagaagaaatgtatgtatgcttatagttttttaattcattaagtaaccaggaacatctatagaatttctttgaggctttaatgagtaaatgatcctttaaaaaaacatctaaactacatggcttagtggtaaggatggtgcaggggcaactgttttctatttattgaaggggaaaaaccttttttgttttaaccacagatgtataaacatgttatgttaaaaaatagcctaccggccgggcacagtaactcatgcctataattctagcactttgagagccgaggcaggtggatcgcgtgactctaggatttcgagagcagcctgggcaacatggcgagaccctgtctctacaaaaaataaaaaaaaattagctgagtgtggtggcttacgcttgtagtcccagctactccagaggctgaggtgggaggatcacctgagcccaggaagcagaggttacagatatctgtgatcacaccactgcactccagcctgggtgacagagcaagaccctgtctcaaaaaggaaaaaaaaagcctaccagccacgtcttccatatttcctttgtggaggggcttgggggtctttaatcatggaaggtacagaatgagacccagcctcccctctggcccaccttgtgcccaccccccatacctggagtgtctataccctgtcctgcctgccttcctgtctacagcaagggggtatctcttaattgaccattaggaaaatgctggatttggagagtagttccatattcagttacatgtcagggtctcttaacatattgcatgctaaattctggccgtatttactctataaaactgaggctgtgcttcaaactatatacatacacacacacactctctctctctctctctctctctctcacacacacacacacacacacacacacacacacacacaaccagataataacttctacccatgttccagtgaccatggctttatggctttgtcaaggagagaaactccacatggggtccagcttgctctgtgggagtgtgtgagggtccctcagagtttacagcttattctgatggtttgagataccagttacctggggctttgtcagtgtgtttctaagaagctttattagactctaatgtgtttctcttaagtggtatttctgtgtgttttttctaacatccatttatttgagaactacctatgaacaggacaaggctttcttgctaaagagggtggctggataaaggcctggcctcagttttgggggggcccaagtcaggacaggtcttttggggagcagagcccttggagcaaggctctcctggaccacagtcgtgaagtggcgaggaccccacgggacccctcatgcatgccctgctttctgtcgtctattgcaggtgcctgcacagctcacgtcggcagggaatgacagactagcacacgtcaggcacccttctctgctgaactgctattaaacttgtttctgttgaaacattttctctcctgtctagatggaggtctgtaagtctacagctgcatctctttccccagtaaggccactcctgtgtcatttcatgcctcgtggctccagctaattaagcgggagagggattagtttctccagattcctcctagttcatggacattactctctctcttttttttttttttttgagatagagttttgctcttgttgcccaggctggagtgcaatggcgcgatctcggctcactgcaacctccgcctcccaggttcaagcgattctcctgcctcagcctcatgagtagctgggactacaggcttgagccaccacacccggctaattttgtatttttagcagagacggggttcctccatgttggtcaggctggtgttgaactcccgacctcgggtgatctgcctgcctcggtctcccgaagtgctgggattacaggcgtgagccaccgcgcctggccaatgtactttgaatttctttctgtcctcagctgtacccttggctgtcagaatactgaccctcacgggctcttcctgtgccatgagattctctgagccgcccttcccagtgcctcagaccttattctgacttcctccctcctggcttacaacaaaagccaggtgttttgtattgtctacctatggtatagctttttggtcaatccacagaggacatctgagggtgaaatgagatggtctgaggaatcctatttgaaaagatgccatatgtctttcttttgtttgcatttacgtcctatgatttgattttttcatggtacaaaagtatttaataagtgacacttcagtacagaaaacacagagcttgtagcttgtcctttaaaaccaggacggccaagtgaaaagtcagtacagagtcttatttttactattaaacaaatcaaagggacacactgggcattgaactactatgctttttcttctttctagagatgacatacgtgttttctgataagtaatgtaccacacattgcactaaagcaaagcagcaaacagccagtaaagctgtgccctgcctgctgctcctgccgggctggaccagtggaacaccatctcggtaggagaggaagaaaatgcagagtccctaacccagagagcctaacaaactggtttataccgaagtgatcttcagcaaacacgcaaacacactaacatgctgtaagaatgttttagtctatttctagcacacagcataaattcgtaggtgcccagtcaaataggaaggaacgccattgtagaaagcatttttgccttcacagcactaacacctaaaaagcacacggcatatagtactttgatctttaagtggataagcatggaagtcccaagatcatatccactagattagcctgagtattcatctataaaaatatatatttttaaaataatgcttaaaagagacttctagaaacagtgggactacatcaggagcagaagacagcgacacaaggactgcaaatgttaagactaggagtggcttttcacgtggaacttttatgtagaggacgtctctttctgttgattgctacagccgagacaagctgtgatcacaggagattctgaaatctcaagctgggcttgagtaacaccctagatagacatcaggaaccccattgaggctgaagtactgaaactgacccatgtgaagaagagataaagagatgcagatgcgcaaagattcacgcagagcctgctgggacagagggtggcggcgggttcatccacacgtccacaccagcgtgtgtgcttgggtggcggcggcgggttcatccacaccagcgtgtgtgctcgggtggcggcggcgggttcgtccacacgtccacaccagcgtgtgtgctcgggtggcggcggcgggttcgtccacaccagcgtgtgctcgggtggcggcggcgggttcgtccacaccagcgtgtgtgctcgggtggcggcggcgggttcgtccacaccagcgtgtgtgctcgggtggcggcggcgggttcgtccacaccagcgtgtgtgctcgggtggcggcggcgggttcgtccacaccagcgtgtgtgctcgggtggcggcggcgggttcgtccacaccagcgtgtgtgctcgggtggcggcggcgggttcgtccacaccagcgtgtgtgctcggggaaggaccccccaagtggagtgctggacatgggctcgctccagaggcgtctgactcagaagctcctgagagaagtgtctccttgaggaggggaggaatactacggttaatgaatacaagaaggtgtttcaggagaaataggtctaggagggttaagtcattttggttttgacctgtcaatacttaacataaatgaagaattacaaaacagagtcagtctttttccaagatgtattctgtcatcatgagctgagcctgttgggctggtgacatccagaatgttccaattcattggctggagggaggacccagtgccgcagattgttctgggaagctggcacagaagatgattgacacaacgaagtcaccactaagccactgcttaagtctagtcctcggccttctttttctgctctgtagtccaaaaccgtgaacgtagcagcatgtcgaatatgtcaccagctgcttcatttttatggtgctgtaatgtggtggtgaaagctgccatgttgaatccagaaatccgctccagcagctgttcttcaatatatttttctaccaaaaaaatgtatgcaggctgggtgcggtggctcacgcctgtaatcccagcactttgggaggctgtggccggcagatcacctgtggttggagggttcgagaccagatgaccaacacggagaaactacatctctactaaaaatacaatattattagcggggtgtggtggtgcgtgcctgtaatcccagctactcaggaggctgaagcaggagaattgtttgaacccacatggcggagactgcggtgagctgataccgcgtcattgcactccagcctgggcaacaagagcaaaactccgtctcaaaaaaagaaaaagaaaaaaagaaatgtattcattaaaaataggtgtgtaggtgagtttattctcttccgtgtcttcaaactccaggtagtacttgtccatgtaatttctctgtaataactggaactcgttatccatgataacgttctctaaatatccaaccacaacagcaaattcatcagaggtggaggagaaagacagcacaaagctctcttcttctaaggtgtccatcactgcagccccgagcaggctcctaccccgcctgtggcccaacctgcatgcagggcgtggcgggcggccgggttaaggtctcgcagccaaagctgcggcgtgctcactgcccagtcagggcagcacctgcgtgccaggcccagccctgggttagggccccgccgggccctctgtgcataccgccgacactgcgggccaaggtctcggtgactccaaaatgatttttatggttttatgattttacttcacccagaattgagataattgttgtgactatgagaagtttgaaaggacgggcctctcagcctccaaagggactagagctggttccttttatttatttttgttttatttatttttttggggacagagtcttactctgttgcccaggctggagtgcagtggcgcgatctcagctcactgcaacctttgcctcctgggttcaagtggttctccattctcagcctcctgaggagctgggactacaggtgcatgccaccatgcccggctaatttttgtgtttttactagggatgggattttgccatgttggccaggctggtctcgaactcctgacctcaagtgatccacccgcctcggcctcccaaagtgctgggattacaggcgtgagccaccgcacccgtcacttgatctcttttaaagggaggactgtactctggactcaccctcacccttgcacttttggaagcgttcctggacattagacccatcctctgaaaggaacttgtcctgttccttctcctcagtttctgtacacgtccttactgtgcagagtgcacacgggagcgcactcagggctgggtgaggaaacagacaaaccgtccttgagaaacgtgaggtctgcttaggaaggctgcaggaaggcacagaggagagccccggaagggagggagctggtgctcagggagggctgattttcagcagacgctcaatttggaaagcctttgggggaaaggtaattgctcagaattgcaaatccttttcttcatgtttagcgttaaagaataacagcccacgttttctctgaaagctttaaaatttctgaatcattagagtccagtcaatgtggttttaatacatgtagcaacagaatgaaggaacatccatcctgggtttgatcaaattacaacagccttaaattaccttagaaacatagttactttattctatttgtgtctacattaaatgtctcattaattcctcatattttctggagtcttgttggctggcaaatcacaagtaatctttcttcatttgcccttggagttgttgtcagggagatggattggagaataaaataggttagaatctattctgatgctgcgaactgggttcttttacgttttcaggacagaaaatagcagctccccaattccacagacttactttgcgtctcgtaagtgatggtggtggtgacgcaggggcagggcttctggcccgtgtcacgttcttctgctcacatggctggagtatggccccaaagtcaccttttctgcttccacattcccactgtgctaaccttctttcctcctaagagcatgcaaattaaatgactccacatcagtcagtacagccacagccttcacttcggggcttgttgactgttgtctgttcttcagactcggatgctgcgtggggtagctctttctgagtccccgcttaggaggactggtcctggtagaacagcgagaggggaagtcgtccttctcaggcagtggctgggattgccatttgcactgcttgagggttttatattaccatcgtgtgggtttgcttttcttcagtcctagtctcagaatctaccttctacttcacacttaaaattctgagagcagttggcaaagctttgccttctctgtctttgtcggggcaccaataacagtcatgtttgattttctggaggaattgatagaaagattgggcgtcagctaaagccaaataaaacattatagcagtatctgtggttattagaatatttgaaatctcatctgatgcccttacctataaacagtttcacaaatcccacacatggcctagcccacctcttcatgtcgcccatgaagtagctccatccacagggcccagatccctcccacacatggcctagccctcctctccatgtcacccatgaagtagctccatccacagggcccagatccctcccacacatggcctagccctcctctccatgtcacccatgaagtagctccatccacagggcccagatccctcccacacatggcctagccctcctctccatgtcacccatgaagtagctccatccacgggcccagatccctcccacacatggcctagccctcctctccatgtcacccatgaagtagctccatccacagggcccagatccctcccacacatggcctagccctcctctccatgtcacccatgaagtagctccatccacaggtcccagatccctcccacacatggcctagcccacctctccatgtcgcccatgaagtagctccatccacagggcccagatccctcccacacatggcccagccctcctctccatgtcgcccatgaagtagctccatccacagggcccagatccctcccacacatggcctagcccacctctccatgtcgcccatgaagtagctccatccacagggcccagatccctcccacacatggcctagccctcctctccatgtcacccgtgaagtagctccatccacagggcccagatccctcccacacatggcctagccctcctctccatgtcgccggtgaagtagctccatccacagggcccagatccctcccacacatggcccagcccacctctccatgtcaccatgaagtagctcccatccacagggcccagatccttcccacacatggcccagccctcctctccatgtcacccatgaagtagctccatccacagggcccagatccctcccacacatggcccagcccacctctccatgtcacccatgaagtagctccatccacagggcccagatccctcccacacatggcccagcccacctctccatgtcacccatgaagtagctccatccacagggcccagatccctcccacacatggcccagccctcctctccatgtcacccgtgaagtagctccatccacagggcccagatccctcccacacatagcccacccctcctctccatgtcacccgtgaagtagctccatccacagggcccagatccctcccacacatggcctagccctcctctccatgtcacccatgaagtagctccatccacagggcccagatccctcccacacatggcccagccctcctctccatgtcacccgtgaagtagctccatccacagggcccagatccctcccacacatagcccacccctcctctccatgtcacccgtgaagtagctccatccacagggcccagatccctcccacacatggcctagccctcctctccatgtcacccatgaagtagctccatccacagggcccagatccctcccacacatggcctagccctcctctccatgtcacccgtgaagtagctccatccacagggcccagaggcattaggatggcacttggacaacccctgagatgggttgtaaagtgttattttatattttgtatgttggatttcttagtcacctttgacgatttgaaattcaggctgaggcttgcaattctaataaggttaattggggaatttagaaatgatttttggatagctccagattttgttttgagtgatcaccattttaacactttaatagcttaattttaaatctacacattaatgtaaattcacgaaatgtttctatgaacccatgacgttcgtccggctttggcctgagtcaggtcccagcgggggctttcttcagggtgtctgtcaactcttagctgggcttttttctgagatggagtcttgcttctattgcccaggctggagtgcagtggtgcgatctgggctcactgcaacctcctcctctcggcttcaagcaattcttcagcttcagcatccttagtagctgggactacaggtgtgggccactgtgcccggatgatttttgtgtgggtttttttttttttttgagatggagtcttactctgtcgcccaggctggagtgcagtggcgcaatctcggctcactgcaagctctgcctcccgggttcacaccattctcccgcctcagcctcccgagcaactgggactacaggtgcccgccactacgccccgctaatttttcgtatttttagtagagacagggtttcaccgtgtttgccaggatggtctcgatctcctgacctcgtgatccgcccgcctcggcctcccaaagtgctgggattacaggcgtgagccaccatgcctggccaatttttgtatgttcagtagagacggggtttcaccatgttggccaggctggcctcaaactcctgacctcaactgagccgctgcgcccgtctggctttttgtaatagaaagaatgatgcactgatgaggagctgggagggaaatttttcctgtgtacgttacgaaattatttcagagttcaaataaaaaaacaggtactttgccaagtcctctcttcctggaagatggtgtccatcctgattttcagcctcctgctcatttttcttttttgctggtttaccaaatactttatactggattaatttacttttaatggcatgacagattctgtaagctaattctgtgcgaaaaagtattttaacagaatggctcacatcagctctgtttgtctccaagcagggagaggttggcagctaagtcattgcctccacctggaatgctcagtgctgacagttgcagtcctgggtttcccaccttgaaaggagatggagtcagaaatggcctctgtctgcgctgtgtggattgctcatccctcctgttgccagctctccaccctgcctcccggggcccgttctgccacagagtgaggtgtcctttcctctttggaagcccatagcagccttgggctgaagggctcaaaccccaggctgctacttcccttgagaattgctcacccaggcgggagggctgctccttccacacagcacagcctgtaaacgtcactctctgtcatcgtttataagcatgatgactgggttttcacgcttccccataggatgggccttccttaaatcttgttatgttgtcagcacattacttgtgtgacgcaaaagaaaaaaaattcactcttgcagtctgccaggcccaacatgtaggtttctgctttttagggcactaaaacgaggacacatttttatttctcagcaaataaatatatgaattctacgtatttttttatgtttcatagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggtaaggaaaaagaagaacaaaaggcctcacttcgtgcttactaaacttaccttcagtgtattgggaaaatttccttttgaaaatgaaggaactactaaatgcattatgattaaatgttgggatggggatttgagcaaaagtgttgggtgctgcccaggtgtttctggttctagtggctgaaacatttgagacgatttgcaaagtttaaactgcactcgacgcagtgattgttgcttcatggggctcatcgcatgttgttcataccagtgccacgtcgacgtttttcctttcccttggcacaggaaaagttctttaaaactactttttaggccgggcgctgtggctcacgcctgtaatcccagcattttgggaggccgaggcgggcggatcacctgaggtcaggaggtcgagatcagcctggccaatatggtcaaaccccgtctctactaaaaatacaaaaaaattagccgggcgcggtggcgcgcgcctgtaatcccagctactcgggagcctgaggcaggagaatcgcttgaacccggaaaggcagagattgcagtgagccgagattgcgccacttcgttctagcctgggcaaaacagcgaaactccgtctcaaaacaaaaatacactactttttagctgcttaagttcgagttgacttatacagtgttaatttgcctgagtttaaatacttatttttagcttcactaatactgtttttaacaaaaaaaaaaatgagcgtaacgtaagtcttaaatgcccacggacctgctcgctgccggctccaccgtcagtgcacgggagctgcttagagagggcagctggctccgccccacagccgtgccgcgtatgtgggtgagggcccgtgacggccctgtcccacacaggctgagtctgtctacccgagtgtcccgctcagttcacaggcgtaggcgtgcagagacgtagaacttacacaacagtacttggttgtcaggagacaaatgacaccccctttgcaaagtgcacttattaaaacagcaagtgctttctgagtgcgtcagctgtaaccatgcaatgtcttcttctcggtgacacaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccaggtgagacagcgggagaggaagcgagggccccaacagcgtgagccagacgcggacgcctgggctccacagagaagaaacagccggactggaggcctgcctgtccctctgtaccttatactagtacctgattttataggccttggaaaactaatagcactgggagtgttttttaaaaatcaatgaaggttctttaaacgacactgagtagatgcctgaaataacttagaattaacctgtttcttagtttgtcattcaaaaatccatgaaacagcccccgcacccccaccccccgcaaaaaaatcaaaacaaaacaaaaacccatgaagtagacaaactagacactggaagcaaaaacatgtcctttttttttttttttttttttttttgagacagagtctcactttgtcaccaggctggaatcttggctcgttgcaacctctgcctcccaggttcaaagaattctcctgcctcagcttcccgagtagctgggactacaggcacacaccaccacacccagctgctaatttttgtatttttagtagagacagggtttcaccatgttggccaggatggtctcaatctcttgacctcgtgacctcatgatccacctgccttggcctcccaaagtgctgggcgtacaggcgtgagccaccacgcccagcctaacatgtccattttaaggaataggtaaaacagtttgcagtttacttagtcataatgtggaataaaaatgtgtgccctggggaattaaacaaacaaacatagtgtggaaatgtgtccaaactgtctgttacagttgacagaaagtgaattgggtcatttgggattcctggccctgccgggccagagaacagccctcccctgcccactggcggtggcccctgacagccatgtctccctctctttgctctaagcccccaaaccatggcagaggcccctgacagccgtgtctctctctctgctctaagcccccaaaccacaaagggcagaggctgggtgccagaggctctgtgacagccccactctgtttttgaactttctgcttcccttccactcgttacaggaggaagatgttgatcctaggtgagtgtggccctcgtctttctggcctacaggggcagtttcttctttttttttttttgttcgtttgtcttgagacaaggtcttgctctgtcactcatgctggagtacagtgacgtgttcttggctcactgcagtctccaccttccaggctcaagcaatccgccctcctcagtctcctaaatagctggggctgtaggcgcacagtaacatgcccggttaatatttgtcgtagagacagggtctccctatgcccaggctgatctcaaactcctcccacctcagcctcccaaagtgctgggattacaggcgtgagccactgcgcccggcccagtttcctcttttattgagtattgacattttcttttttataaagaactgtgggaagaggggttaccagatatctaaatagagccaaaattgcatttttagcagttagagataggaattaaataccccttttaaaatactacacctccctcattattagtaactttactattgtgaggtgaaatagggccatatcctatattttaaattaaagtttgtatgttgcttgtcagtgctgagtgtgagaacctttgtttgtagaagtcagtatctgtaagtgtcagtcctgctgtgtctttcaccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaaggtaggcggaggggaaaggaggagaggggagaccacagggaggtgaaaggtgggccggggggggaaaggaggagaggggagaccacagggaggtcaaaggtgggccgggggggaaaggaggagaggggagaccacagggaggtcaaaggtaggcggaggggaaaggaggagaggggagaccacagggaggtgaaaggtgggcgggggggaaaggaggagaggggagaccacagggaggtcaaaggtgggccggggggggaaaggaggagaggggagaccacagggaggtcaaaggtgggccgggggggaaaggaggagaggggagaccacagggaggtcaaaggtaggcggaggggaaaggaggagaggctgccccatcagcctcacactctgggaagtccataagatttgctcatccttggccaggtacagtggctcacacctgtaatcccagcactatggggggctgagacggtcggatcacctgaggttaggagttggagaccagcctgaccaacacggagaaaccctgtctctactaaaaatacaaaatcagctgggcatggtggcgggtgcctgtaatcccagctactcgggaggctgaggcgggagaatcacttgaacccggaaggtggaggttgcagtgagctgagattgcgccattggactccagcttgggtaacgagcgaaactccatctcaaaaaacaaaaaaaagatttgctcatctttttctaatttgctgtttgttttagagacattttctagcaggtgtgatagctatctggttattatgttttaaactggcaagatttttatttgctttccagtaatattaatgtcgtttcttttcctttaatttcagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatggtaagacatgctggtcggtggctccccgtggctgtgggtactgggagcagagccccttctcactcgtggtttcggttctgactgtaacaattttagcttttgtctgaggcaatgtttgcatttcgaagctgcaggaaatctagtcatgctggggaagtggtcgtggagtcggccgtcatgggattcccgtgggaggacctgcctgaaaagagatgagagtttctaatacattgagagggaaaaatactctcgcctcttgtagatttcctgggtgtggcctggaagcggcctgaaacggcgggagccgccgcgtgtcttttcccttggcctcgcgcgccctgtggcctgtggcggtgctatgctgctgagggtgggagagaggctgcttttctgtgcgctttgctctcagagtccgtccgaggccggtgcacagaaaaccgcacggatgttctgacattgacaagtggagacaccagaacctccgcgccgacaccgggttatctaccttcgccctgccctgtggagtgtggaaagggtgggagtccctgctggctgccgagtcaactctggcattggggcctggctcaggtgtgggctcccgctgctctgggttgggtacatgtgggctgttgccggctgtgtggctgatcctggcgcttgcgggatctcaagcaggcaaatccgaagctaccgactaaaactgtctctgtgcccacgacacgctttctttgaaagagggtacaggtcagaaggctttatcacgacgtttgaatccttaccgaacgctacgaacagagaccttgaaacctgcaggtacctcctactctgactcagcaccaccctgcctctccccaaatttatggaagaacaaggtctggaaccttttctagggaagactgactacctggggttttttttgtttttaagtaatagcaacacttgctgcctgtagatagatcgcagagtttgcagtcatcagttacctgtttgaatgccttcgtccccaagccctgtgtctcctccttctcttctctctgggtaactgtggctgtggatgctctaaggtgataaacctggtggcactgcaggtagctgggaggagatggaagccgggagggctggcgattggagggcaggcggttggagggctggctattggagggcaggcggttggagggctggcggttggagggctggcggttggagggcaggcggttggagggcaggcggttggctttctggtcttagtcactcccagtctgaagacaaggcagaggcctagtgattcccagattcgatatgtgtcagaatcacccagaaggcttggctgttagaggccagagtgctgcgttccccagagttcccgactaggcctgtctggtgtggggcccaagaatgcatttctgaaacagtccaggtctgccaagagcctccggtgcaggtcagaggctttctgggtccacctctcttagaagcagtttgaaaaaccgtatccctgcctggtatagtgcctcacgcctgtaatcccagcactttgggaggtcgaggtgggtggatcacgaggtcaggagttcaagaccagcctggccaacatggtgaaacaccatttctactaaaaaaaaaaaaaaaaaaacaaattagccgggtctggtggcgggtgcctgtagttgtagcttctcgggaggctgaggcaggagaatcgcttgaacccgagtgtggaggttccagtgagatgagatcatgccactgcactccagcccgggcgaccgtgcgagactctgtctcaacaaaaaaagaaaaacggtatcctttttatgtatttaagttatctggaatttttcattataaatttaagcaagtgttttaatttttcactattgaaaatattgatgttttaaaataaagcttttacgggattattttcagtgtactactggactccaaatacagacatcatgagatgtccacttgcccacgtgtggacacacaggcaggagcggcccagatcctcccttgtctgtggcctggtctttccatctcacattccctaacaggttttgtacgagtcacatactttaggcttaaatgtcatttattagtcatatcttttctctgcagcaataaaatatagatataaatattaaagtttgtctatgagtaacaaaattgataaaacccaaaaatataacaaattcttataaaaccaaaaattaaaatgttactgaagatgcctttcttagtgtatttagctttaaaggaaaccacctgattcgttctgtattcactgatggttgcacagtcctagtgtcaacactgagggcctgtttccactcaggaaggagaggacagtgtcagcactgagggcctgtttccactcaggaaggagaggacagtgtcagcactgagggcctgtttccactcaggaaggagaggacagtgtcagcactgagggcctgtttccagatgaacgtgaaagtctgtcagtgatcttggctgggtgtggtggctcacgcctgtaatcccagcactttgggaggtggaggtgggcggatcacttgagatcaggagttggagaccagcctggccaacatggtgaaactccgtctctactaaaactacaaagattagccgggtgtggtggcacattcctgtaatccctgctactctggacgctgaggcaggagaatcgcttgaacctgggagatggaggttgcagtgagccgagttcagaccactgcactccagcctgggcaacacagcgagactccatctcaaaaaaaaaaaaaagtcttgtcagcaccagtatttcctattattgctttcatgctccatcccatagttttcatccccaaagccagtgcccagttgagcagatgagagaggctgttcagagagaggaggtggcagatgggctttaagaaaagacttcaggaccaagaggagattctggaaatgattttccttaaaacagtgtcggctacagcctggatgctgaacacctaggatgagaaccactgcacaggtgctcataattttggcctcttgtagtcttttattttttatttgggaggtagtgtctcaccatgttgcccatgctggtctcaagctccggggctcaagcagtctgcccacctcggcctcccaacgtgctgagatgacagggtgagccaccgcctctggccagcacgtcttttcatgtactttatggttatttgtgtatcttctttgaagaaattttttttaagtcctttgcccatcatttaattgggttgtctttttgttgtgaaatttgtagttctttattcatatgtagagatttcaggccttttcagacatgtaggtgtaactcagagacattgcagggttggttccagaccactgcaaaaaaatgaatattgcagtagagctgccagtcacatgaaatttttgggttcctactatattaagcaattatgtttatactaaattgtagtgtagtgtattaccccaaggaaaatgtagtatttttactgaggaattatgtggatgtggccgagttttctgacccaagcatggggttagaatgtcctgtgcagggagggactgcacaggctgcctgagactctcccaggggtaccagagggctcagcaccacgagcagataggccgaggctgggctgcctgccctaagggggttccatcctcaccctggccccaagggcagcctgggccggttctgcctctgccaccagctgctgtgggacccggggctcagggcttggcccctgcgtgtgtcgtgaagacagtgctgacagatgggaggtggggctgacaggacgaggggtcaggatgttccggccatgcactgtagccctggccttgcaggacagcaggtggcttggtgggatgataggtgagttccgtgggcaggcgcagggcatgagctgccagtgtcttcctggaaggtgactctggggttgtcgctccagctggagtgtaccctcattcctgcttccataggggtctccatggaggcctcattcaaacacaggcgagcccatccctggcctgtcaggttcaccagggtggcccctggtcccgttgtcgccgttgtccacaccctgcccacctgccaatgctcctgtgtcccctgctctgctccagggccccaaaccctgtgcagagctggggtgcatcatgctgccgccccatggagaaggcctggaggagatggaagccgggaggcttcctcttacaggaagggaagccccagaaatgtgcctggcaccaagaaactgctccaagcttgttccagagtgtggggagggcttgaggcctcccctttttgagtacatggaaaggaaagcctggcattttctggaaacgctcccaagtctccctggcagggagatgtgggaagagtccaggcgcccaagctcttgcatattcacttcctcccatcacacgtgctgtgtacaagcaccctcagagctcgctttgggagacccctgcctcagggctgcgggtgccgccgtccacaccacaggcccttctgcttcctgtttccaaagctcatctcctgtctctgggctgcaggcgctgtttctggtttactggcacaactgtggttgtgtttttgtcaatgacttcatctttgctgctgttgttttgagatactgtcttgctctgtcacccaggctggagtgcagtgccgagatctcaactcactgcagccccgacctactggtctcaagccatcctcctgcctcagcctcccaagtagctgggactacaggtgtgcagcaccacatccagctaagtttttgtattttttgtagagacagggtctcactatgttgcccaggctggtttcaaactcctggactctggtgatcctctagccttggcctcccaaagtgctgggattacaggtacgagccagcatacccagccagtgttgtcgttttgatttgggagttcggggctgagctgtgtttggccagggcctcgcctgctcagtgtgctcctgggctgagctgcggtcctggagcatctcttggctcacatattgactcctccggcctctctactgtcctggtccttcatggggctcacatgtgtgtcctcttgttttctttctgtcaccttcttaagggttcacagatcactgtcagtggaaggtgttgccacagctcaagcctcacagtggaggaacctcatgaggcccttcacggggccactccctgtctggacaggcctgcctgaccagccctgctgggaagcctgggctttgctgctgcttcaccctgcgacattctcctcaggccctgcctttcgcttctttcgttaacattgttcctgccttgatcgtttgctccctcctgcctaactctgctcttcttccttgtgtagcagttacgtggtcctcaaatatcatttgttgactccagtgtttcctggggcatctcctcaagctggctggggttctctgcatctcagctgtggcgcctggtgtgagggcgcacgcttcgcagtgagagtgaaatgcccagttcgcgctggcagagggagaccctgtgaaggtctccctgtgccaggcacaggctcttattctgaaagcagaccccgtgaaggtctccctgtgccgggcacaggctcttattctgaaagtagaccctgtgaaggtctccctgcgccgggcacaggctcttattctgaaagcagacccagtgaaggtctccctgtaccgggcagaggctcttattctgaaagcagaccccgtgaaggtcttcctgtaccgggcacaggctcttattctgaaagacccagtgaaggtctccctgcgccgggcacaggctcttattctgaaagcagaccccgtgaaggtctccctgcaccgggcacaggctcttattctgaaagcagacccagtgaaggtctccctgtgccaggcagaggctcttattctgaaagcagacccagtgaaggtctccctgtgccaggcagaggctcttattctgaaagcagaccctgtgaaggtctccctgtaccgggcacaggctcttattctgaaagggtacgcagcagtttctggaaggaaggaaggagggagggagggagggagggaaagaggaaggaaggaaaggagagcgataggcacagaggaaggtagatgaagccccgcgcccccctggcggagcccagccctgttcaccgcgtgctgtgcgggtgcctgtgccaggatcagctggctggacggctatagccccacgcctgcaggccacatacctgggagagtgtgggccttccgagccttctggctcccggccccacagaggaattacggtcccatgtccctcacaaggacccttgcagagggagcagtgcatcggcacagagcaggacacaggggagccgggctgaggctgcgggtcccttgtggccgccaggtgctcacgcgtgcctcggtggggatctggcagccagatttggggtgaggatttgatgatgtgggtatccctagctggtcccacagtgacgatgggtgttgcgttgtgagcatgtaaaacggcagtgacgtctgagggtccctggacgtctttcacacccagcctcaaagcggagcctttccaggcagagcagcagctgccgccactggattgacagccccagagcagcgggatcaggccacgcggacgaggaggtgcgaggcctcgggtcggggcctgtgttctgcgggagccgcacccatcatcgctgtggcggtggcagtggagcagctgctctcgtgtctgagctgctccggcgtctctgtccacagtatagggtcttctgatgcttcctggaggtctcggaggggcttgctgcgtgtagtacccacacagcccacaactggggtgttgtcaagtgttatgacgtaggttgcctgtggagtaaaagttggccgctaagaaatgctctagacaggccgggcacggcggctcacacctgtcatcccagcactttgggaggccgaggcgggcggatcacgaggtcaggagattgagaccatcctggctaacacggtgaaaccctgtctccaccaaaaatacaaaaaattagctggacatggtggcgggcgcctgtagtcccagctattcgggaggctgaggcaggagaatggcatgaacccgggaggtggagcttgcagtgagctgagatcgcgccactgcactcccgcctgggcgacagagcgagactgtctcaaaaaaaaaaaaaaaaaaaatgctccagacacttcagtttgaaaatattggaatttatgtggggaggattagtgtgcatggaaggccaaaaatgtgaatgcatctccgcagtcatctttccaaaagccgccctctgaatcagtgaggaccctcagggtggggaacgtccccttgtgagtgtctgcagattggagtaggcagcagcggagcccgtctctgtagatggactcgcagaggaacttagttctttccctaaaggagtaggaacagctgggcgccgtggctcacgcctgcaatcccagcactttggaagaccagggtgggcagactgcttgtgcccaggagttcaagaccagcctggacaacatggtgaatctctgtgtctacaaaaaatcacaaaagtggctgtggcggcagcacctgtagtcccagccaccaagaggctaaggcagggagatcgtttgagccagggaggttgaggctgcagtgaaccgtgatcgccccactgcactccatcctgggagacagggtgagaccctctccacatagtaagtaaatggaggaatagaaacgcaagccggcatacattgtctttgacagcattttgtggataggcaagttctaaccatgggggcaacgtgggatgcagcagggtttggtgtgccgtggggcaggggtaatttgcttgtttctctaagactttgtacagctctgtaaacagattcccattaggtcgtcctttccttgtgacaggtaatagtggaggtgtcacaaggtaagtggcctgtcttgcctggttttcaggttctacggcttttgtcttgttttttgagaaagggtctgtcactcagactggagtgcagtggcgtgatcacagctcagtgcagccttgaactcgtgggctcaagtgattctcctgcctcagcctcctgagtagccaggactacaggcacgtacaaacatgtccagctaatattttttttcttttgtagagatggggtcttaccgtgctgctcaggctggtctcaaactcctaggttcaagtgattctctcgcctctgcctccccaaatgctgggactacaggtgtgagccaccgcgcccagccttctccttgtgtttgaactggagaggacagagtgctatacatgtggtcacggtttttcttcgttgaaagctctaacagtggggtcggtccctgttattaagcctgtgtcactattccctgggccctaaaagtgcacctggctcctgtgacttggggtcctttcccactcctctccccagggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacagactgcgaccgcgattgcagggaggagcatctgaggtggtcacggggtttgcccagctcacaccaactgcaggtcagttcctgcttcgccttcagtagcctgagtcccttcttctttttctttcacgttactagggcagttgttcgctgacgccttaattctggaacacgttccttgcccagattcttggtggctgcttgttcccttctcatcgttcctgctgtgttttccatgcttggtgtagggggaccctcagagcttggtgtagggggagcctcagagcttggtgtagggggagcctcagagcttggtgtagggggagcctcagaggtggcgtcaggacgtgcctgccccaccggttgccctggtgccctcgtcacgccccgggaccgcgcacacgtggggactgtttccagacgcactttctgcgggcagtctgtgtggcagggctccctgcccagctcctgcagcctcatcaagtctcccactaaggaggtgtcgctcctccaactttgttctttttaaaaatcgcttcagccattctaggtccttggcatttccgcgtgaactgtaggattcctacaccaagcctgctggcgtcttgattgggacggtgttgaatccagagtgtgtggcagagctggcggagcccctctttctttgatctctgccgatctccttgatttcacgtttgttttattccacagaccaccccctccccatcttctcacctacttcaggttccatttcatggtaggaaattcctgtagtcctcccgggcttgctgaagtgctgctccaagttacagtccccgggttgtcaggcgtggcgagagccccttgtgctcagagctctcacggaacacagagcaagcctgtctacgagttcagccggtgaggggcaggggctggtgaaggcggcggcgcctctgggtgtgcccaggggcagggtcgcctccaggccccacgcgctaagccgtgactccctgtaacacacccgtgtcgacacaggtcacgtgggcccgaggtgctcatacatcacactccttgtccaggatggtccttcctggcaccatgtggtcctcggtgcaaaccagagtttgcagtgctcgctgcacagacccttctgccttattcagcatctttagatcaacagagtcagtgccttcccaagagagcacgtgtgggcctcatcaggagcatgtgcccaactcgtgtgtgtgttccttctctgccctggaggagaggggtcgccctctcttgtggcccaccccggggctgcagggctgatggctgctccctccccagctccggcacctccagggctctgctgcctttagtcttccttgcgtgccctccacctccctccgagcctctgctgagacctctgcttcagggccgggcgtgttagcacagcccctctgctgttacagggctccatgtggggtctccacgtggcggagtacctcgcgacagaggctctgtgagggcagggctgggtggatgagagtatttaagtgtcaccatttcttttctttcttttttttttgagacagagttttgcttttgttgcccaggctggaatgcagtggcatgaccttggcttactgcaacctctgcctcctgggttcaagcaattctcctgcctcagcctcctgagtaactgagattacaggtgcccgccaccacacctggctaattttgtatttttagtagagacggggttgcaccacgttggccaggctggtctcaaactcctgacctcaggtgatccgcccaccttgacctccccaagtgctgggattacaggcgtgagccaccgcgcccggcctcccagtttcttttcactccaggcctctcactactgttctctaattgacacagaataattgtgcaagtgtatggggtgcacagtgatgttgagaagcatgtgactcgtgatcggcacatccgtcatctcattgaccatttctaggtgttgggaaccttctggctgtttgaaaccgtattgttgactcccatcatctcgcagtgctgcagaacactaaacttattccttctgtctagctgtcgtttctagttttacgtctttttaaaaattattcctcctgtctgtcatttctagttttatgtccttttaaaaattatttattttttatagagacggggtcttgctatgttgtccaggctggtctcagcctcctggcctcaagggacccgcctgcctcagcctctcttggggttgcaggcgtggaccactgtgcctggcctacgcctcttgtattctctgggtcatccagtcaacttgagccctggtgagggtgaggctgttgggttgggtgagtcagccgtgttgtgctgccgtaacagaacacccaagatggaagactttagcatgaacagaaacggattggcttgcagttctggaggctggcaagggccttcttcctgtgtgctcacgtggtgatggggtgaaggcatattcacccttttagaatgaactcactcctggaatcatgagcctgtcccttggtgacagcattaagctgttagtgagggcaaagccttcatggtcaagtcaccttctgaagatgccacctcctaattaggctgcgtgggcaagtgagtttcagcatttcaggagacagatgcccacaccatagcagtgacctcatctcattcagggtattggtgcttgtcagacactggctgtgactcgcatctgggtgcgtgtgcctctctctgtgggggccaccctgccgtcaggcgccaggaaaccgacgtcagggaatgtgggggtctccctgagagggtgccgacctaacacggctcctccgggtcacgtgggtgggctcagcggcctcccgtgcctcccctaggtctggagtctcccctgccctctcgttgggctccaagcctcttcctcagcccagcttcctgctttgtggcagccgtgctttctggaagctgagcagcttcttttttttttttttttttttgagacggaatttctttgtcccccagactggagtgcaatggcacgatctcagttcactgcagcctccgcctcctgggttcaagtgattctcctgcctcagcctcccgagtagttgggactataggcccccaccaccttgcccggctaatgtttttgtatttttagtagagatggtgtttcaccatgctggccagttcgagactggtcttgaactcgtaacctcaggtgatcctctcgcctcagccttccaaagtgctgggattacaggcgtgagccaccgcacctggcctcttgttcatgttttatgtgtaaattggtcctctgctatttctgttgctcagaggtggaaaggagaagggaacacgataaagtcacacatccacactgttgacaggggtttggcttccagggaacacacctctgtggcctcagggctatgtcctgaattctaaaacggggctctcacggctgacccgatgtcactgggtccccgtttgctgcttgagtctcttcggagcccagtgttgactcccgctcttcgtggctgccccggctatctggccatgaggagctgaccacgcacctggccggactcacatccgctccgctagggaagacctgggggcggaggtcggtctctgaccagccagcgtccctgcaggggactgcgagtaggaggcgggtattgcccacgccagggcctgtggtctgagagggctggcccttgacggacaggtgggcaagtccccctcccacatctctaggcaccagggcgtagcgtaccatgtgtgctgtgtttgtggttgggttcaggtactgccctgtaggcgtgtctgctctgagcctcctgggacagcctgaagtggttgctgcacagctgctttggggcctcccaggggtgtgttcctgctcccaccctggggtgctctgagttggtcttgggttagagaagtgcagtggctggtgtgtgcgcagcctaggggcctaggacctgcttctcagagcatcacggggcccaccaagaagtgccccctggggaggtgacagcgtcttccagaaatgccgccgcccacaaggaggactggcctgtgccggaagctggagatggtggggtcctgatggcacctggtaggtgagggtgccccagagaaacagagccaaggcggcggcctggagacagattctgtggaatctgcccactctgttgtggggcctgccaagctcagcatctgcagggtggaccgaaccccggggaaagagtcagtgctggattctcaagagtccagaggccatccagggcagagtgctcccctcagaggacctcagtcttttcttagtccttcacctgattggatgaggcccacccactcatggcgatcagctgatttactcagagctgactgatttaaatgttaatttcatctaaagaagtaactatacagaaacatccagattaatggttgaccaaaatctgggcactgtggctcagccaggctggcacataacattacccatcgcatgttagttggaagcttggcctttggaattaactcagcctggtcagccgttagcagccagcagtctctgttctgcccacacacctctgtggactgacccaggacacaggtgagcagcatccatgagaaactgtggtgcttctctcctatgggacagatggagccccgctcccttctgtgtggaaatggtccaggagcatcttgtgcgggtggtgggggggcgagggcagggcctccgcatgagggagagcagcgagcggcagccactccttcgccgagccagcagggccatctcctgtctgcctcaaccactactggactcagcctttctcccccagcagtgacatcaaaatagcctatttataggacataacaaagatgatgccagctgttaataaaaatgtccgctaatcaggcagttcacttgctgcagttttttggggtcccaagggcccagcccaggctcctgtgcccttggccaccgtgggccagtccctggggtcttgtgggagcctccgcgggcctgggagtggcaggacccttagagggcgagagttcacatgagagcgtggggttctgactcgcgagggttcacgtgagagcgtggggttctgagtcgcgagggttcacgtgagagcgtggggttctgactccctcgtgtcatttcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacctgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttttagagaggaaaaaacctgtattttcctggtgggatgaaatagggatgaaatggctcagaatggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgtggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctcttgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgttttttttttttttttttgccgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaatggaa

SEQ ID NO: 203 - DNA, 70898 bp, Homo sapiens; identical to SEQ ID NO: 158

SEQ ID NO: 204 - DNA, 3819 bp, Homo sapiens
ccggaggagtcacgtagctctgcgacatccgcagcctcatttaccagagggagccagggctgcagcctcatctgtttgcggatcagaacccgagctgtgcttgtggctgcggctgctaactggctgcgcacaggtaaggccaggcaaggcgggagccactcaacatctccgcttcatttccttggctcttcccctgccatcctcgtcctgctacctgggactccgggatgtgccctttcgaccctttcctaacatctttgctcctttccgcgtacttgaaaccccatggctcaacctcttctgttctatccctcttcagctctcccagctggacctcagcttttccaatcccaaatcctcctctacttgttggatttttccttggagtctgtctctcctacccagagcatttccttctcagcctgctccctctcctcctaggctaggtcctctctccagttctcccgccttctctgccccccggtctaggtctctcccgctgactggttagcctgcatcaccactagctcccctcagtctcatctctctctcaggctctctactcctttcagccttggtcctctgccctcccgtctgggtgtctgagttgtggggaattgaagtgcttcctattgctatcctcctgccaaacaggtgaagtgcttcctgggcacagagatgacccggaggtgtcactagccctagtctccacacactaacacagctgacccgctgggccctctttcctacatcactgcagccccactggggccaacctctggtactgggtgggaataggcaataggcataggcaggcaggtttggagtacagaaaaggagaagctgcaggagcctgtgactggtatttgtgccactcctactccctacctgttcttccaaccttttcctctagaagctgagagaagagggtggcaataagtacttttgcctcattctgaagccttggaagtaagtacactttccctaggggtcctgtggaggatgagaaaagggaagctggaaaggccaggacttttgcctacctcaacaagggaccaagttcagtgaaagaagggttggcatccttgattgggcagcagatttatcagaagagctgtggcttcagggctgctcacctccccacccccaccctgcatctttccccagggctgggaaggatgcctaccagggacaaaaggagatgtgggaactggagccctaagcttgctagctgtcagaaggactggtgccacttgatgcccaggactcatgccaaggactgctgccctgttcccagccccttgcttgatggggaggccatttggcccatctggccaggagaggcagcagagggtgaggtctggcttttttatcttgtctccactccagggagctgtcaccatgcctcactcgtacccagccctttctgctgagcagaagaaggagttgtctgacattgccctgcggattgtagccccgggcaaaggcattctggctgcggatgagtctgtaggtaagtggacatctgtagccaggtagggtacaggtggctaggggaccctggggatgttctcactgcctctctttgtttgcccctaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggtgcagcccctggccctgctctgaatggaagctgggtgtgaaaataagcttgtgtaggaggggtagcaaggagaatcctgcctggattcaaccctctgcttgtacttcctctacaggttgacaagggtgtggtgcctctagctgggactgatggagaaaccaccactcaaggtataggatgggtgggcttgaggaccaaagaggtgttagatagttgatgctggtaaaagaggggcagagtaatgaggttggcactgtgcttgcagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcaggtgtgtgtgttgggagggtggtgagctaggtgccctgtatgcctggtggggagagagtcacaaggctttcttcatctcccctactgcccctcccaagcatctctgctcttgcctgcagaatggcattgtgcctattgtggaacctgaaatattgcctgatggagaccacgacctcaaacgttgtcagtatgttacagagaaggtgagtccacacctgggcacacaaacatactgcagggacagctcggcaggagtgtctgttccccagaacccccagcttagatccaggcacactttcccctagcactttttcacttcatcccggcacaggcctgtgatctgagcctgtactgagccctcacagtctgtgcccatctacccctacatagggagcatcgagcagtaaccagtgggggcccagacccttagtaaacctcctctaatccccacccaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggtactacccagctccctaacctgctcctatccctaaggcccatcttcaggtccttcttgtggccttcaggggttccctatcctggaaaaattgggagtgaccagtcagtttgtcttctctcctccacactaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggttgggagctacaggtggtggtgggtgggggcagcacccagaggctatagcctgggcagggcttggcacctgtgggctggctcagcctgcttactccacgctcccttttgcaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 205 - DNA, 79761 bp, Homo sapiens
atacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaagtaagtttgggggcccctgctcttcctcggcgcccggttctttctttctcgcccacttgggcgacccctgttgcgagctcggcccgtcccccccccgcccaacatacacatccagcccttggcagtaaagccgatgacaccggagaaaggacacgcacgcacaaagctgctaaagatgtaacaaagacgggcgagggggagaggggcctgtcggtgcgtcggtctgtcctctccggcgggctggggctgggaggatggcccagcggaggagcgggggagtgttgttgtttgctgacaactgagccgagagctcatctctttgaggtcgcttttcttccttttttttttttttttttccggagccttctcaggcagacaagtgttgtttttctgttgctcgttcctgggtggggtggggattagaagccgaaagttggaaaccataggcagagctcagaggttccagaaagaaaacacacagacacacactacaacaataacaaccaaacagctctccacggcgtgggctcggctctgtctctctctctccctcctacttcgcctttttccttccctctagcagcaggactgggctcaggccatcacgtctacggacacagtccccctgcacgtccgttgccgtggggtgccaccgccgcccccccccccccaaagaaggaggccggcggggccaagcaacgccagcagctcgccccggacacgccgtcctgagcccgggaaacttggccgtggggacgcggctagaaggaaactttgggatctttgagaaacaatagttggggaagaaggtgtgggctgttctgtgctttttctttattttccgggagacggctcttgagtgagcgcacagggcaagcaaggcaaacgccttcctggtcgatttctactccccccacccgcccacccccagattcacgtggatagtagtgcgtgggtgggggtgtgctgggaaccccaccctggcctggcttcttttttgtatttatttgtttcatttttgcccctaccagccaggtcacccagctttccccaggcagtcgactcagcgccctaacgggggcacgcgtgtgcagcgtatccagcaccgtcctcagaataatagctgtgaaaaggaggaagggaactaggcagacagaccgacagatagggggaaaccgggatgtttaatgtgtccgaacaagtaggaagatcaatgaggcgcgagtgtgtgtgtgtacgtgtgcgcgtgtgtgtgtgagagagagagaaagaaagaagaaaggtcccgattgcaacgtgtcagatcttgcaaccttccccccacccaacacaacaaccctcagacacaaaaacaccattgctgactgataccccaggtcttcagggttaaaggaaccgtgtgttggcagcgcaattgtgcagacgctgtaaggccaaaacgaggatttgtgttgtgaggtcggtggtgcgttcttttctttctcttctcgcctgttttcccggagtgcctgggttgcgagaaaggcgcatcgcaggctgtgcagccgaatcgcttcgcaattattcatgctggtcggagggggatggggcgcgggaagctatgtgtgcatttgtctggagggtagtttctgaaaagccagagctggtggggagctgggtgaagacgtggttttgtttggtgtgtttgcttttgttgcaggggggaggggcgcgatttcttcagctacccccatccccggctaccagttctctggagtctgtcccgtggcgttggctctgactaggggtacaccccatgagggcacgttggcagtgtgtggcaaacctggcttgcccccctaccccagccaccccccctcaccagcgaggtgtatggaggaggcggtcggagattcctcagcgtcccgccccccacttcgcacccgcagacaatcggagacctccccctgccccaccccccaccccccaccccgccgccctggccgccgccacctcgttgtttaccccgtgccggggctccggcgtggccaccagtcacgtaagcagagagccgggcgcgccgggcttgggctgccccgcgcggggcgggcccgtggcggcgtaaccgggctccagaggctggtgaagccgaggggcttcctcccagcccatcgcccgaggcgtccgccctgcaaatctgccagcccccgagaggggtttggaaccttagcacccaagtctaagtcaacttcatgtgcgtaataagtccctcggccccgcagcccccctcctccggccggctcccggcgggagtatttttagctctcttgcttcttttcgccgctgctgtttggctctaaatgacgtgatgccaacggcccccagatttccccgagagcttggggcgccgcgccgtgcccagtttggctgcagagaccccgctccaggccctcgccccgtccccaacagctcgaacaggctggggtgacctccggcaaactccgtgcgaccatccgccaggccctctgttatcccccttgcaaagagaagcggtccacgggggccactttatcccaccccctctcctcccctcctcctgcccggtctaggtctctgggtacggaaaacggcgggccctacatctgcctcgttttatggggggcgcttcttcgcgctggcggcgctcgtcgttgttttctgctcgctgcacacaatgcccgcgcgtcacggcaatccgcgtgtgcacagcaataacgcgagtcggggggcgggtcgtgcgtgcgcccggctcgggcactgcgggtcgctcggcgcgcgcggggcttgttttgctccagagctctgctttccgaaacgcttacatcattcagtcgttgggggagggagagggatctgggcgttccgataggattccagcatctaccgggtccctggtttctggaaggaagcagggaccctagctttttagtagttattattgggggtggggttgggtagtttgttgtgtacgtctttttttttttttttttcggtcactactgcaaaagggcatcgttggccgactcaggtgcacaacctccccgccttcatttcagcgagttcccctataatcacttgatctcggtttctccgccttctcctcctccccctcccagctagagacacatggtttccacatggagacaaacttctttcctccgactggacttgacctagctgcgtcgttcagccaatcggcagctccagcctcttctgacgtcacgcgttgctggggccggaggctgggtggggggtggagccaggctgcaagccaggaaatctctgggagctgtagtgcggccagctggtccagtctcttcttaaagggacgctcttctgtccggagatgagtgtcgggccccgattctccatttcgggttcggtgagacctttctgagatgcatggtggaccctggtcacgagttaacacgttccgtttttactgctgtttgcgaagtacttacttggcaggagcttgccttattttccatcgtagccagaactgcttttcgttcccttgttgaggtttccgtactggtagtgttcaccaagttgtggccacatggctgaattacttccagtggagaggttgagttttcttggaggaggggttcaaattaagtcacattgttgactgtctgctgtgtgcaaggcaggggggattccctaggaaaggcaggtacattctcccaaaactccaactgatgtgaatctctacggatcacaaattgaaggcctccagaaatattaatcatgaaggctgtgatcctattaccacaaattcagaaattatatgtaaataatctctgacatcatcacctatatgcattttgagtccagtggaagggtgggaattaaggactgactaataagtagaaaaagatcttggaaaaggttaaaactaaaagagaagaacagatccataaagggatgttatgtgcataagagccgactggcaggtaagtgaaacaagctgtgagagcaggtaaggtctggaggagagaaatgggcttcctagtgtctggaggaggttgctttggaggcaacacttaagatagggaaggacgatcagatgagagtagaaagccataaggctccttggagtggatcacctgggtttgagggtggggtgctttcctaggggcacggacagcccaagaaacagcctgttcctcctggtagaggaagctgctgttgtgtggtgtcatttggccccaccctgccttctgacttaatctcctcttccttgccctgaaacctctgtgtctgtacagcagatccaccagcaagcaggcttcacagtcgaacctctgtgctcgacttagactcttccactgtctagaatgctttcattctcttactcccctagggatatctgtatcctaccttctcttcaagacttagatcagtttccacctcctccaggaagcttcccctagctatttcagcccatttggctctatttgttaagtcattgtacttgagagaatgaaacctttgcagtcacatggagcagggcccagcttgctactctactgcttactggctttgtgactttggacacaacttacttagcctgaggttccatttcctttttgcaaaatggggataacaatagtatgaccctcatatcattgtcaaacaactcaatgaggcactgcacttaaatatttaacgtacctgagatataataggtgctcaataaatagcaacttctctgagctttgataatcagtaccatgcacttctctacttgcttcctgtgtgttagctttacctttacaaggagtttattagtaacttaagagaaaagatcacttacagtattcaatgcatgttacccattgcatatagcacaccactgggcatacagtagtagatccttaatataaatgttttgattggttagatttgtcatttactgctagctatggcacgaggatcaggtttggaggccaggggacacgtgacagcctttccgaagatttggagacgagtcagaaatactgatctccaactcccttgggtggtgagaccaatccctgcaagaagatgatagttcagacctgaagagctgagactgcatcctgtgaacagctgtgaccctgagaaacaaataagaaagaaggagactagagtgacttctgctgaaatcgagggctttgatggcaactaatgttcaagctggtcacgtttttgcatggcagcaatcttatgaattcatacattcttcaaatgtacattgaatgtctactatgtgcagatgcttctttctgaaaactctgtaggttgaagtatggtgggggtggagtagggtatttgtctttagtggagttatgtgaagagcattcttaaatcaggccctatttcctctgcatcccaaattatgttccccagattcaacttattttttccagttttaaatatgatctctgctgactggtaaataccagaagaaggcttttttgaggatattgttacggctttcagaatcacggagctcccaaggactgtgtgtcctggaaaggagatccagggaaaggggacagggccttggaagttagagaagttgaattgagccattcctggtttgggagcaaaaaggaggctccattagctaccaaggcaaaacagtagctgctcatccatctctcatctctgatggaaacagtctcccactgacacatccagaaatggggattcatctggagatgcctgggcaaaagtctagaggtgaaactgaggaaaatgaagagggtgctggcgtgcagcagcagcaactaattgtatggcataatatcaataatggctacaatttattgaacactgactatattccaagtatggggctatgcattcattatctcccctgatcttcacaacaaccttctgatggatgcaattttattaccctcttttacggaggagggaactgaggagcagggatgccaggtaatttgcccaaaggatatatagctagtaagtcgcggagctgagttttgaacttaggcctctgattccagagcctgtgctcttaaccatatacacatgtactcatttcacagccaaggaatgaagtccagagaagtgaaatgacttactcaaggtcacccaggaacctgaagcagagctggtatttgaaacaccttgtttattgtccaaggtcttcctgcacacaccttgcttagaaaaggtttcgaagtgaggctggagtcagaagagccaaccagagaggctttttttctttttttgtctttcagagttgttcaactctcctggccttaactcaagtttagggctcctaggaaacaccacccccctcctgctgcctttcccaagtctgtcctctgggcatattagaggacttggggctgttgctatggtactggggccaacagcaggttcatcaaaagccgggtcttttgccttttgaaaaaaaaacccagccctgcagaagcgaattggccacaaagatttgcatcagtcattgtggcttgttctgttttagatccccctgcctccctaccccaccccctcctccctaccaccaccactttctataaatacagttggataaatattgatttaaactgggtttctggaggagaagcacatgcttgccctggcttggtcttcacttagataccaccagtatgtcaggcctgacacacctaacccccgacagctctggcttccaaatgtcctgttttggggagatgaattgtggttttgtggcttttgagtttttttttttttttttaaaggagagaaagaaaaagaaataaaaaagtaacaacccagcaagaaatgggagtcttcctgcagaatgaggaaagcaattttcagcaggcagaaatgggggagctttatagtaatatggcctcctgaaccattcttctcccttcccatttttctttctgctccacttcagtttttttttttgttttttttttttttttgagatggagtctcactctgttgcccaggctggagtgcattggcacaatctcagctcactgcaacctccacctcctgggttcaagtgattctcctgcctcagcctcccaagtagctgggactacaggtggttgccaccacgcctggctaatttttgtatttttagtagagacaggttttcaccatgctggctaggctggtcttgaactcctgaccttgtgatctgcccaccttgacctcccaaagtgctaggattacaggcgtgagccaccacactgggtccaggttttgtttttaaaggaggcaggtattagcacagagcatcagggccagaaggagccccagaggtcacagagcatccatcatctgtacagtcatggagtctgagacccagagagggacactggcttgcccaagatgacacagcagaggcagaaccaggtccttctgggctgtgttccctcctacctgatacgagaatgggttccaggtagagtcccaacctgggcatttgtttcacaggtccagtgctcataaagtcagcaattttcaaacctggtttactgatcccagggtgtgtccggttattgcaaaggtcattgcaacattctcaatagtctttcaaaatgaagctaatttcaatttgccatacttagaaaaatactatcttttacatttgggggctgggaggagggaggagctagaaggtggtggcagtgatgaggtggctatcccaagccttgactgaggaggaggaattcaagtcttggaggatccttctggaggtggagctctaggctcacagtggggagagagaaaaaaaagagagggagggaggatggaagggaacgggagaggcttcaattccctgtcccaaggacagacacctgctctctggctcttctaacttaaaggaagcaattgtctctgatgtcattgtacccgagtggcctggctagaggtgttaaagctgtcaacagctgacttgatctttgtggtcaaaaataatgggcatttgccatcatcatgctgagcaggaggctccttctttgcttcctcatcttggcagaagtgtgctgggccccttgcttatgaaatgttttgaaagttcaggtgacccttggtttgagcagtacgctccagggaatatatgtaaacagaatcctttttcaaaaaaatttagagaaactctcttgaaaagcccttgtggcaactattttggtaagatgtggaattatgttgtgagccattctccctaaatttgtgtttattcattcattaattaaaccagtacataaggagtacatacttgcttaatgggaggcactgtgctaggtcttggaggtagagtccttgccctcatggagtgtattattccagtgccaggttttagaggtagagttcctgtcttcatggagtgtactgttccactgccaggttttagaacttcacttgtcttaaagtgaaccccaacaatgcaggatggcatttgacttgagtatttttgtctttggttctagctatcattatagacagaataaaaatttagcctgggcttccaaaaggagtagttctttccctccctgtctcccctatctgtgtttaatgttttttttttttttttttttggagacagggtcttgctctgttacccaggctagtacagtggcacaatctcagctcactgcaacctctacctcctgggctcaagtgatcctcctgcctcagcctcccgagtagctgggactataggtgtgtgccaccttgccccactgattttttgtattttctgtagatacaaggttttgctatattgtcgaggctggtctcgaactcctgggctcaagccatcgacccacctcggcctccaaaagtgctgggattacaggcatgagccaccgtgcccggcctacaatcctttgtgtttttgtgtttgtccttgtaatttctacagatgttttttttttctttcactgcctgagcttaggaaactgtgtaagcaaccttgtaagtaaatacattccactcgcagttctttacagataggggccttctgcacttggaggattgtccacaccagcattcctcccaagtccactctcctgtacaacatgctcttggccacagacctctaatatccaactccagtgtctgtaaggaaatttagacacagcaaaattagaaagataaacacactgtccggagggagagggagattgagaaattcaaactgaagccaattaaaggggatctggattacctactatttgaaatttctttttctgtgtctttattgccattagcaaggatacttgaataaaggtgatttgggagtaggaaggctattgtattaaagtggaggacatgcccagggctgctctgggcaagtgagagctggtgtggactttgtttttatttctacaggggcccagaactaccttatggtgcccctgtgttatcttcctcttacctccaccacagcctgaccgtcctgccatatttcttggctcccaagactgtgtgtgccttgcatacaacttactttcatttttttctgccagtggtactgagctaagtttttgttgaactgagctaagttcaacaaataatttctaaaacctgccagggagccaagctctgtgcttggtgattccaaagtgaagcatgtatgatctccagttccaggtctatcttctagttcaaatgatagacgaatagaaatcagtcaacaattcttgtctgtcttctgggagagtgtgataacctgtccccaagagagctgctgacaagtgcaatgtcttctctgttttccaaaggagtggtgataatgccctcctagtattgagcatttactatgggccagcacaatgctacgtgctttatattaaattctcacaaacatccaatatgcaggtgctataataaccctcatgttgtagatgaggaaagccttagctttagcaagactaactttcctaaggccacagtctaataaatagtggagtagagactaaaaccccagatttttctttcttcctagagagaccttagggctctgggaaaagccccagggagtaagaaatgtgcaagagtcaagaattggaatctggaggctgggcacggtggctcacgtctgtaatcccagcactttgggaggccgaggtgggcggatcacgaggtcaggagatcgagaccattctggctaacacgctgaaatcccgtctctactaaaaatacaaaaaattagccgggcgtggtggcgggcgcctgtagtcccagctactcgggaggctgaagcaggagaatggcgtgaacccgggaggcggtgcttgcagtgagccgagatcacaccactgcactccagcctgggtgacagagtaagactccatctcaaaaaaaaaaaaaagatttggaatctggaatgttttaagttaggctgagggtgcccttgaggatgcctccctggagcgacttccttttctccccactcttgctagggtagagagtgggctgtcagaacctccagggccctttgggtgttgacagtggagccaaatggctcctttctctagacggagatggtctagggtgtcactgcttgcacctgcagtagtaccttgcccagcaccccctggggaactcacccaaccagtaggtctcctgtggttctgcatactagggtgtcagggtgtgaatccacaccctgtcaggcttattaggcttcctggaggcgcccgagcttgtagggcaactgggctggcccatacatggagccaagggcttctgccagggaagccagaggagagaggcaagtgtgagctgcagagatgagcattaggtcctcgctgccaccgtgacagtgtgggccagctggttccagtcagacaatgacataggccaaccactttctctcgctgatccagagctaggaaacaagggatcttaaatataactgcatttgtctgggcgaggtggctcatgcctgtaatcccagcactttgggaggccgaagtgggtggatcacctgaggtcaggagttcgagaccagcctggccaatatggtgaaaccctgtctctactaaaagtacaaaaattagctgggcatggtggtgggtgcctgtaatcccagctacttgggaggctgaggcaggagaattgcttgaacctgagaggcggagcttgcagtgagccaaggtcgtgccactgcactccagcctgggagacagagtgagactccgtgtcaaaaaacaaaaacaaaaacaaaaaacccaaaatataactgggttcctattactcacttttcaaaagcccttcaatagcttctttcctgcctcacttaaaataaaatccaaactccttgtcatggccttcatcattgccgttcggagtgagtgtgattggaggatggagagccttggtaccccctgggagcttgtcagaaatgagactccaggtctgctgcagtagaatctgcatttgccacaatacccaggtgatttgtgtgctccttaaagtttgagaagatgtcttaaacagtctttgtgatcatcccagaactcctcacccagccacctaaccttatcccatttttatcatttatcctgtatcctgctcatcacaatttacacttactctacttgcttatcatcagtctggagggctggaatataagcacatagaggacagggaccataagtagttttgttcattattttatctttggcatctagcttagtgcctggcacataacagatgcttaaggaatatttattgaataaatgattagttttctgtctttatctttctgacctagtgtttctcaacacaggagctgttggtgtgacagttcttgtacagattagtttggaatatggcaggatttaacatccttggttcccacccactaaacgccactggaacgcccccagtcattgtgacaataaaaaagacactcctacaatgtttctaccgcctcctagtgtgatgggattgcccttggttgagaccattgctttaaccaatttcgtttgacctgacgcgattgaacataacatgatgtatgctgtagggtccaagggtcagaaaattcaagttccaatctgttcatagcctgtgtgaccttgggcaaatcacctatcctttctgggccttatttgtaaaataggaatctcagaggtgtgctgaggattaaatgaactgactggaggagcagcaccgtgcatgttggccctagttatgtggcagctagtaggcaaatggatgtgtattgttctaggatctagggacaatcccagcttcctcaaatcaaaacactattgctggaagagctggtgagatcagctataccttggacaggcaagagaatggtatttttattataagtgctgcatctgaggctgagagaacgcagatacaaggcagcaggagctggttgtgtggtttagtgttcagggcctggctagacctaactgtgacctccacaactttctgctgcctggaaaagggtggtgatgccaaggggtgggggcagggcaactcgaggccagctcctggcaggggagggagggttacccagggctttggcaagaatgtggggcatcctcttagcagcaggagaaggccttaaaaacaagttacatctaactttgaaagaacagactattgcaataccaacatctaggaaacacaacaaaaaatacagtttacttttgctttcaaatatagatgcagaaatcctaaacaaaaatatcaactcttggaactgaacagtgcttcaaaacaataacacaccgtggctgaccaggttatttgccagatattgctgaaagtcacaaaatctaccagcataaatgattacaggcacaaattaaagaataaaatgtgtttacactaacaaatgttgaaaagtatttgggaggcatttctaatgaagaaaactacttcggcacaacaaagattgtttcctgtggtggtcttttaattatagtggaagggtgaggttgggcccaaggtttgcggtcatcaccaggagtgaaggagttgactctgatggcaacctttccttggggaagaatgaaccataaacagaaaaaaacagcatttggatcctttgggaatgcaacttcgtcttgatatttaaaggaatgggccccacgggtttaaaaaagcctgagttctaacccttattccatcagtttgatagacagctgttggccttgggcaagttaccatacctctctgagcctcagctttctcaagtgaaaaatggggactgtattgagaaacaagcttaatgacacaaacttctatgacataaaccttgaaatgttatttggggaaatattcacttggcatggccctagcaaaatcctcccaaataccttatcagtagcaccctggtgtcaccccaagtggggtgctccaaagtaagcaagccgcttagatgtgcatgttaattgagtcctgcaatgcagatgtcttcttggatccaagttcatgcaaaaaagaaggaaaaggacatttgagagattaacacatccattataatcactgaaataggctgctgtaataagggccatttaataaaatgtaagaagcccttttctaagagggaagagatgggtcaggatggaagtcaagtgcagctgtttgagcatttgccagtggtctgatctcaccagtaaaactggagttaaaaagcaacaaacttccagattcagccgtctcagataaacactgcctccccctggcgttccccccaccccatgtcctttccctttctccccagctcgggcagcacctgagtcgcttggtgcgtttccgtgtggttgggatgtcagccggcagccctggcgacaggagccctgggaggcggcagctacctctcgggtttagcattacgtcatcccttctagacccaaatttatctcggctgcacacagacccgcagctctgagctgccgctgacttgaggagagcttacgcatgaacttaggcaaggctgactcactgggcgagggaaaggttttctgctgttcttcacgtttctgggctctgggggaagaggaggggaggaggctgcagtagtcattttgggatgggagatggaaaaatgtataactgttaacggttctcatttaagagcttagagttcacctcccgtgtccccagtgttgattatttgaaaacgcccatccttaaagataattgcagaaaacagtgccctactcagtaaacactttgcagtttcagggaagttctcctaagtgcaaggtgtcatcaacacagtaactttggacttgtaacttaacctcatggccccttcctctctccccatctcgcctccctgaagaaaagatacaacacatcagcctccattgtttatgaatctgcaataaatcacttggaaattgtcactaagtaaactgtgctgagaaaggacccttaagaattgagggctttgcctgcttccttcagaaggcagattgtccccatccgtggctgtgatcgttataggcctggggtattctgggggactttctccattttcaaatgactcccttgagagagagatatactttagggagaggacagaacagagactatgggtaggattccaggttcttatgtcagtagactttggaagccttgcttttcctgtttccccatctgcatttgtagtgcaaactagttcatcggaacaaaagaaaggctatggctgcctctgggttcctccgggctgagactgttgctgagggatggtttgtgggtagcattactttcctgtggatagagccctaagctttgtgctggagaggcccttatagctgatgtccaaggaaggactccaggaggcagccagcgcagggagaaggaagtggcacttcaattgcttttagaaaaggctggagatttctgtacatgaaccagcccttaatactgcccaccatgatcatcatctctccccttcttcaatgcaggtggccttttggtgagtctcgctctactttccatgtcctcatctccctcttggccatggctctagaagaagggctctaggttagttcacctggaggtcaactgtgaaaggccatgcataggccccaggcctcttgcatgtagccatctcttcctaaccagctatggttctgtgacctctggaattaaagccatcttgaattcatgtatattttcagtttgtactacttttcttgattgcttgtcacacaagtttacctcctattgagaaaagtagagttgtatttgtcctggccagggacactttgggaggctgaggtgggcgagtcacgaggtcaggagtttgagaccagtgtggccaacatggtgaaaccctgtctctacgaaaatcaaaaaattagctgggcgtggtggcaggcgcctgtaaccccagctacttgggaggctgtgtcaggagaacccgggaggtggaggttgcaatgagccgagatcgcgccactgcactccagctggggtgacagagtaagactccgtctcaaaaaataaataaataaataaataaaaaataaataaattctaccctcaactaacagatgttctaaatgaatggtattttctttaaaataatccagtcccacccctacccaacatggcccttgttgagggtgaagggaggttgttaccaacacccagtgggaaagtccagatccaaaatgacctgggaaagtccagatccaaaacgacctagtcaagagctaaaagaacagtccctttttgaaagcctttacaaaaaaaaaaaaaagttcttctgtggcttgcgaacacctctcattttgggtctgcttgcatttgatggaacgtctatttggtcttaaatgtggtgccaagtgtaatatttaaaaggactggcagaattttgcagcttgtgacctcactggagattttgttcactttaccaaaaaaaaagaaaagaaaaaagaaaacaaaaggtatgagggaaaggtaagaaaacaaaaggtatgagggaaaggtatattaaaatgcagcatgaagccgataacatttttaagagggtaagatttccatctcaagatggtattttctgcaggagccaatggaatgaccacgggagggggaaactcccccctcaccaggagcttcctgttattttggatgtgatgtcaagcagcaggttaatataattggggtggaaaaaagttatgggtatgtttgcacggttcccagcttgttcctagagcattcaagtacgattctcttgttcttcctctccctagatcccttgttcccaactgggggacaggggagggattttgtgccccaggagatatttggcaatgtctagaggcatttttggttgtcacacctgaggggtggtggtgtgctactggcatctagtgggtagaggccagggatgctcctaaacatcctgcaaagcacggaacagagctcctgctccaaggaggaattacccagatcaaaatgtcaatgatgctaaagttgagaaaccctggtctagactttgaggattttttaggtggaggacttagaaagagagtggccatgaatgagcagtcagtggctttttttttttttttttttctttgagactgagtcttgctctgttgcccaggctggaggccggagtgcagtggcgtgatctcggctcactgcaacctccgcctcccgggttcaagcgattctcgtgcctcagcctcccgagtagcttggattacaggcacccgccaccatgcccggctaatttttgtatttttagtagagacagggtttcaccatgttggcaaagctggtctcgaactcctgacctcaggtgatccgcccacctcagcctcccaaagtgctgggattacaggcgtgagccactgtgcccggccagtggtagtcttttaatgtggtctccgctctctaacttcctttttagctacagaggagagcataagagaaaacatcatcatcgcttctatttactgagtgcctagtatatactaagtgctggaattattatatttaatctttgcaaaaagcactactgaatacacaaacctcgagagcaggtctgcgtccgtttctctcttactatgcaaactaagtctagtacagtgcctggcacatggcacgccctcaacgccgtggatatgatcatatccattttatacataaggaaaatgaggctggaagagttcacacaggtctcagtgtaagtagcagagtcaggatttgaaccaaactgttccgcaccagggagaattttctggcgtctaaaagcactagtgaggagaggagaaagttttaaaaagtaagattaaagaaaaaagtaactacttgtctgtgtggaagctgaggtggaagaagggcttcatggaaaccctctctgatgaaatcatccctcgtttttgaacagcaattttggcttttccagtttctgtgtgcgctgttggtgcaggtgtgttactcttcttattttgcagatgagcaaactgaggcacataagttacatgagaaagtaggagatagaggactggaacatgatacttcgaataaagaatgtctcagcccctgggcaaccgcagggagtcgctgagaaacaagtttccccgggagtagactcccagctcgctcaaatccttcccattccacatcgtgtctggagggaggaaaaaaaaattcttccctcccagaagcaaagtcccgcaacttcttagtcttccctagagacaggaaaggaaacccagcgggactacaccttccgacgacctttgcgaatcttgcggaacgcaggcgccctgaaacggcgtgtgcactacgattcccggcagccgcgggcgggtgcgggactacatttcccagggggcagaggcaggggcgggagggggcgggccccggcgctgctcccgcccctcccccgtgctcgcggggagaggtaaacaaaccacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgaggtaatggctgggcgccgctgcgtgagcccgagcgctactaatctttttcggcagtgcggtgcggccggtaagggagggcacgcgtgtgaggtgcgcgcatgaggtgaggtgtgcgcgcatgtgaggggaggggtgtgcgcgcgtgagggtagaggagcgcgcgtgtgtggggaggggcgtgtggggaggggagcgcgcgtgaggggaggggcgtgtgagggaggggtgcgcacgcgtgaggggagcgcgcgtgtgaggggaggggcgtgtgagggaggggtgcgcgcgtgtgaggggaggggcgtgtgagggaggggacgcgcgtgtgaggaggggcgtgtgggtaggggagcaggcgtgtaaggggggcgtgtgaggagcgcgcgcgtgaggggaggggcgagtgaaggaggggagcgcgcttgtgatgggaggggcatgtggggaagggagcgcgcgtgtgggaggggcgcacgcgtgaggggaggggcgtatgagggaaggggagcgcgcgtgaggggaggggcgtgcacatgtgaggggaggagtgtgtgaggggaggggagcatgtgaggggaggggagctcgcctgtgagggaggggtgcgcgcgtgtgagggaggggtgcgcgcgtgtgaggggaggggcgtgtgaggggaggggagcgcgcgcgtgaggggaggggcgcgcgggtgtgaggggaggggcgcgcgcgtgtgtgtgaggggaggggtgagcgcatgtgaggggaggggtgcgagcatgtgaggggaggggcgtacgcgtgtggggaggggcgtgtgaggggagggccatgcgtgtgtgtgagggcaggggtgcgcacgttaggggaggggcgtgtgaggagaggggcacgcgcgtgtgtggggagggtcgcgcgtgtgcggggagggtcgcgcgtgtgtgaggggtgcgcgcgtgggagggatggtgcgcgggggggaggggcgtgtgcgggaagggcgtgcgcgtgtgggaggggcgtgcgcgtgtgggaggggcgggtgcggggaggggcgcgcgtgcgtggggaggtgtgtgtgctgagatcgtgagtggaggcgtgtgtgagaggtcgcgcaggtgctgggggaggtgcgagggtgcgcacggagggtggggctgtgggtgtgcggcgagcgggaaggagacgggtggagggaagttggagagagggcggtctggggctggagagagggtgaccgtggagaagcttggagggccccggagcgggagagggtgctgggagataagaggaaggaggaacacggatgctggggggggtcaggggaagggacgaggccgggagaacactgagcgggggaaaaccggtggagaggggcctttgaatacctgcggggtgatgagatggggtccctttagcggtggcagcccaaggggctgtagagatggcgcagaaagaccaggaactcggagactgtggtgtcgagagagaaaatgtctttctaagacttgttcgaagtacacaaaaatattgggcttaaagagactctttagaacagagagagttgaaagtaaaggggaatttttgaggcaagcgaagtcaatgaggtgaatggtaactggtcacaaaatttttgttctaaagcatctgaaatctcaagttcttgggagagaaggattttggaaaggggggataaactctttggtttagaggaggtatcaaaacaccttccagctggtggggtgtcacaggattgatgtccaggcgagggacattaattttctaaccaaaaagagtggaaacattttacctcttttcctgctttcaaaaacctgttactgcaaagacctcggatttgtgggtcaatggatttgggtactatattcttcttaccgtatctttttttcttgctttcttcagagtgtgaacatggctacgcctcttcattcccgtccatgccgagcccccgactgcagcattcaaagcccccacggaggttgagccgggcacagaaacacagcagcgggagcagcaacaccagcactgccaacaggtagcaagctgggaacgcttagaagagggaactggagggaaggagcacatttctcctgtaatcccaagtctgaaggagcagcacttgatgggttcctttaccactaccctggggatttggcccttttaaaataatgaagtctagaaatcataacctggttttgcatggaaggaaaggaatataatctggaaagacaaccaaagaagttcttgctgggattattaagatggctatgccaagttgagagacttggcagcatgtgtccatgcatgcagccacctgctaaaagtaatcgtgggctggctttcaatattctggccaagttttggacagtccaagaagattaaaaaaaaaatcagaaataggtctggcagggtataaagcagaatcaagggtttgttaaaggaataaaaatatttaggtagaattggtagtgagcggatgtggttatttgtttaaggagaaaagggaagaccatgctgtgaaagttttgcctctttaaatgatgagatcggattggttggtgggctcttaaagcaaaaaggaaaaaaaaatctgtttatctttcaagcagaatagatctttaaaaatatacttgtctagatgtacttggaaaggctgggcctagtggcttacgcctgtaattccagcactttgggaggctgaggtgggaggattgcttgagcttaggagttcaagaccaacctggatgacatagtgaaactttgtgtcaaaaagagaaaaaaatagatgtactaagatgtagctgacttccatttttgaaaacttttgagtagtatgtggctatctcttcggtgtttttattctagggagccagtgaattcctaggattcatctcataggaagttttcaaaaggcctttcttaacagaagattaacagatggctgccttttccattgataaggggaattaaatgagacctttatttctgtttcccagagctttgtctagagaatataataaacattcattttgaggaggacagagcaatccctgggtaaccaaatttccctgaaggctttggggagcttcagtcaggtggttggttagtcatttgggacagcagattgggtcagaatggggctcttgattcagaaagcctgaggcttctacagataataattggaactcatgaggttggatcatcccactctgtatttcagacatcaccgaggaaaaactaggattcacttttctcctttgacttctctatagagctgcacgtttccttttttagcttcttttcattaagactactatatagtttttaaacttaatttcttaagttataaaaataattaaccataagcttgatgtactatctgtgttgtgtgtgggtctagagattttgttgtagtatggtgtatttgagatgaaaatatgtagtatgatatacagcattttaaaaaatgtacatttgcttgcccttacggtttcagtgtttaagctatcaagaattaagacctattcaggaatttatgtgtctttcaatccacatagattaaaaaacttttttttttcaacttggagacataggaagagtacacataggaaactagacctgggttctgtcgtgctgcaagtatttaagcctttcctattttctagaaattaggtatataatttcagtacatttcccatcccttactgtattcatctgtaaaataagatgcattagagtctcaccaaggtccctccttctcctgaacttctatgactctgatttattgacagttttagagattggttactatattagtaatttagtatgtctcccatcattgcagatgtgacatttttaggaactcaaggattatagaggcataaataagatgcacattcctaagttttatcaattatgttaccggtcattaataagaaactcttagtcatctgttgacttacgctttgctcagcttggggtttgggctaagtgatgtttctctttcatgctagtgtctctgttaggattctaatattatgtgtgggaccacagtgctaattactgtgttttagcatagcatgtcggaaaatttgtaaaactgcaagcatgccatattgttctgatagtgcccaaaggagaatatgtgtacattagaccacctaaaacaggagaagatactttttttatgggaatataagtagcaagaaagagagagagagagaaaaatatattttagaatatattatctcaagatccaccaatgtgtgggttttgggctggggcttatgagagagaactagtatgttaaaatgaaacactagaaattatttctcctttgccacttatttaaaatgcctgcttcatggaagtaaggagagctgaggtagaaattccaatactggggtatttggacaatagtgttggtccatttgaaagaggacactgtaggcttcttcttaattttaagtttactattggattttaatgagattttattatgctggttacataaagcagaaagttagaagacttacagaaatttccatgtatttatcatctgaaacaaggaaaggaatggacttcataagtatatatgtcttattttttcctgatcaaaaagctactagtgtggaagtagctgttattttattactatacatcttgaacactgatgtatgttataaaatgacatttgtttctctgacatcgtagcatctttaagatataatggtgattgactattttacccctgatattctcaggtattatatgatatgcctgataaaatgttactttaggcagggtgcagtggctcacgcctgtaattccagcactttgggaggctgaggtaggtggattgcctgaggtcaggagttcgagaccagcctggccaacatgatgaaaccctgtctctactaaaaatacagaaattagccaggtgtggtagtgtgtgcctgtaatctctgctacttgggaggctgagacaggataattgctggaacttgggaggcggaggttgcagtgagctgagattgcatcactgcattccagcctgggcaacagagtgataatccaccccccccccctcaaaaaagtaactttataaatttatgctgaaagtagttaactcctaatattataaattcctattcccctttcccccattccttaaaatcttattttcaaagaagtaaaaaggagagaaaataaatgatataatgtgatattacaaatatgttccttgcaaataccagtaattttatcatttgggatccttctgatagttggaagtggcacctataatatataattaaaataaatgcttgattttactgtggtcttggtcacagccttctggcacacttccaaaaatcaacattgctaagatgttactgctgttagagaatgtggctgcaatagctatctggctttttggggagcatcagataagttcaaattccagcttctttactatttggtaccacaggtgaaaaatctcaaggtctgtcatccttaaaactctactaaataagccatgactgcagtgtaacactgatttcttcctaaatatctcttcagtcggccttctttcctgttaccttcattactatcctcctaatctcagctaccatcatctcttacttggacgactgcagtaacttcctacctggtgtccctgcaactacagtttttttttttgtctggttctgttgcccaggctggagtgcagtggcgcgatctcagctcgctgcaagctctgccttctgggttcacgccattctcctgcctcagcctcccgagtagctaggactacaggtgcctgccaccatgcccggctaattttttgtatttttagtagagacagggtttcactgtgttagccaggatggtctcaatctcctgacctcatgaaccgcccggcttggcctcccaaagtgctgggattacaggtgtgacccaccgcacttggccagttcttatgaattacattggccagccttcttttgattccttcagtacgcgttttcttctacctcaagatctttgcatactttctgttccctgcagggaatcattttccctccccctttgttatctctgttgaataacactcttcttcagctcaatcataagttcctcaggaatgtttcctcatctgccgtagtagatcaggtcttcacatacttcatggcacccctatttttccttcatagtgttcatcacatttgtagaaatacagttatccagttgtttcttaaattcgtgtcctattcactggattaaaaaccctgcgaggcgggcagggattgagtctcttctgcttaaacatttatccctagtacttatcacagtgccccgtaaatagtatgtgtttcttaaagaatggaaggttttcaaactccaagcagactgtcttaaattgaatttcttttttgtgctgagtaccatattagactggaaggaagagtgataaaacccctgttttggcaaactctgattactttgtgttccaagggatgttaatgatacatttggaaaaacagcatgtagtatttaaagaataaaaatctctaaactgtcaattcttttaaacaagcaggctacagaatgctacacttaattttgaagaacattcagtgtcatcctgtgtcatgaaaataaaataataccaaacttgcatattgaaagaaacagaagtctttcagatattggcaataaatattcatatgagcctgtgacacacacatagtaattgcattgttttaaggtaatctgggaagtagtaaatagccaatttatgctttaatttcaagttgatatatttcttctctttagtgtcctatggatactaaagaatctcataaaagcagtatctcagttccactttctaagattgaggacactaaaaaacaacttttctgttgtttataaggctttagtttaatttttcttaaactgtagaataaagaaatgctttagtcttattttagatagaattattgtattgttattttttagctttgcatccttttcagctatcttcatggatttttagtttttctggggagagggatggtggtgaattattttcctaggatagtttcaaaggattttttccagtagtaatttgagatgctttatcttctctttattctacgtgaacctatttgttcacagaagaattgaatgaagccttatttttatttttgtgtaatttttttctactattctgtgtttttcaaatttttttatattaaaaagtagtttctgggtctttgttccgtagaaaactcccaaagtttcaggacaaaaatgtagattagtagcagttaaactcttaatgatgttgttattattcttaagtattttctgcattttgagtgattaacacatccagtgaaatgtgttttgtgatagtctgtcttctaccaaaattgacttaaatgaaaaattcccaagaattacttatatgccttatactaaaaaaactgaggctttcctttaaatgcttctttgaagtgtaagtttgctattgctgggtttcttaaggttatattcctctatggaagtattgaaggaaacttgtatgatcatgccttgtaagtcagtaggacagctgtttctgttcctagtcgatgaaaggcatttttgtcaaaatattgaatatatgatgtagaagatcacaaaatgtagaaagggaattctttagtacaattctctgatttatgaagacaaaatattatcactcattttatgattaaagcacatgtggcttagagatggtgattgcttaagccttacagctgtagatgatggttgactttattgtcaagctggattttaagcaatatatgcatcattgttataatcaggcagtactgttgactggaagaaagctttctcttctagatttctccttgcaaatgaaagaacattgcctgcttttgaatatagcatgattctttgtcatttcttcagtaaggacagttttctagatactaatctaatcaaagaggcttgatggtatgctttgacagagtgtatttccaggtcccatttttagtgtgattgtatagtgctgatgaaatataaacatgcattttttgttagattgtttttttgttttggtttcctacattttaaaacacagtcagtggtaccataattaacagcattacccataatatcaaacctatttttttgaagttgctcctaacttttatattattattaatatactcagctcctccccatagatgcaggtgttatacatctatggtaccactcgtttttcccccaacagttatttactgaatgtttatttcatgcctgactcttaaaatgattacctttggaagtcagatgagttaggaaattgctgatattttctgtacttttaaaggttttttagaatattgctctgtaatagaatttgttgttaacaaatgaagtagtctagataattagttgtttaccttaatgtgttttttaacttcgagaatatgtttaagagcaattattttaaccttcaaaattctctgtagtttctagtgttgctgccttacctaagaaatattattttacaaacaatatttaactttagaatgtataagatgcttcttaatttctgctgctaccaggtgaactagttattttaaattcttaacattttataaaggtaatatatgtatatagtttaaaaagtcaattaatactaaatagcttataaaggaaaataacatccccatgccccacctctctccatccaatttctgcttcttagagactaccacttccgataatttcacagcttcttctgttgtttgctttcatatttctaaatgagaagcgtttcttgctatagaagatgagaatttgactgtcatactctttgactaacagcagattaatatgccagaaatgaagatttttaaaaagtacatgagagcaaatattctccaaaggaatgatgtttccaaatgagatactttgtagtactgtttattattaatcacctacagaaaaacattgatattttactctcatctctgagtactttatggtaaattattgcctcagtttcatgatgaggtttattagttaaaaaaaataagcttggccgggcacagtggcttacacctgtaatctcagcactttgggaggctgaggccagcagatcatgaggtcaggagatcgagaccatcctggctaacatggggaaaccctgtctctactaaaaatacaaaaaaattagccaggcatggtggcgggtgcctgtagtcccagctactcgggaggctgaggcaggagaatggtgtgaacccaagaggcagagcttgcagtgagccaagattgcaccactgcactccagcctgggtgacagagcaagactctgtctcaaaaaataaataaataaataaataaataaataagctctattggccgggtgtggtggcttatgcctgtgttcccaacactttgggaggccgaggcaggcggatcatgaggtcaggagttctagaccagcctgaccaaaatggtgaagcccgtctctactaaaacacaaaaattagccaggcatggtggcacacgccagtaatcccagctacttgggaggctgaagcaggagaatcacttgaacccggatagtggagtctacagtgagttgagatcatgctactgcactccagcctgggcaacagagtgagactccatctcaaaaaaaatttttttctctattttcttctagcagtttataatattaggttttacatttagatttaaaattcatttagagttaatttttgtagagggtgtgaagtaaaggttgaagttctttttttttttttttttttttttttttttttttttttttgcaaatggacatccagttgttccagtatcatttgttgaaaagactatactttattcattaaatggccttggcacctttgtgaaaatcagttgaccacagacttgtgagccttatttctggattttctgttctgatcctttgatctaaatattcatccttattctaatgccacactgtcttaattattatagtttttcaaaaagttatgaaatcaggtaatgaatgtattccgacttggttcttctttttcaaaagttcctttggctattctaggtcttttgcatttttattttaattaatttatttttttgagacagggtttcactctttcacccaggctggagtgcagtggcatgatcatggcccactgcagccttaaccttctcgggctcaggtgattctcccatcgcagcctcctgagtgaggagctgggactacaggtgtgcactcccacactctgctaatttttatattttttgtagagataggctttcaccatgttgcccaggctggtcttgaactcctgggctcatgcagtcctgccacctctaccttccaaagtgttgggattacaggcgtgagccactgtgcgtggcctgcatttttacataaattttagaatcagtttgtcagtttctacaacagagcctgctggaatttttattgggattgcactggatctataaattaatttggggaaacccaacatgtattaactattgaatcttctaattcattaacatgaattaatagacatggtatgtctattacttagatattttcaaatttcagcagtattttttaggttttcagagtatgggtcatacacatactttattaaatttttccttaagtattctttgatgctattttaaatagcaattaaatttggcattttggttttgtgaactgacttcgctaaacttaattgttctaatagtctgtatattccttaggattttctaaatagacagtaatgttgtttgcaagtaaagacatttttatttcttccatttccttctgtgtatttccttttcttgttttatttcactggctagaacctctagtacagtgctggatagaagtgatgagagtggacattcttgccctgttcctgatcttatgaaaaaatgcattctttgaccattgagtgtgactatagtttttcttagatgccttttaggttgagtaaattcccttcttcccttatttgctaagagtttttatcatgaatggatggtaaattttatttaaatgctttttctacatctatttaggtgatactgtcattttcttttttattctgttaatatggaggattacattgatggatttttgagtcttaaacctgcattcctgaaataaatcctacttattcatgttgtattttgtactgttgcagtactgatactaacaacacagagctaaaacaaacttcacaggtttgaggatttagtccccaacatgtctgccctcgctacagatgccagccataagttcaggagtcctcaggccactctcacatctgaccaactggctgcaaattcagaggttcctacagccccttcaggtttgataatttgctggaactacttataactcaggaaagtgctacactttgtctgtgtttagagacagagtctcaactgtcacccggagtagagtgcagtggtgagatcaaagcccactgcaacctcaatctcctgggctcaaggcagtccttctgcctcagcctctcaagtagctaggagtacaggcatgcgctacaatgtccagctgttatgcttataattgcaagttttattataaatgatacagatcaggaccagccaaatgcccagacacagagagagaggtctgggaggaacctggacacagagcctctgtgctttttccatggaatcaggatgcattactctcctggcacatttatgtgtttaccaaccatgaaactcacccaagtttcaggttccagagtttttattgggatattattacataagcatgattgattgaatcattggttatatggttgtcaattcccagtacttctctcccctgtgttgggccacaatcagtgactcaaagccccaaccctctaatcacatggttggtctttctgatgtgaccatcccctatcctgagttatctctccttggcataaactcaggtgtagtccgaagacccactatgaataatgaagacacacctaattactcagaaaatttcaaggttttagaagctctgtcccaggaactagggtactttctgtatattattgggttcaatttggcaaaattttgttagaatttttgtgtctgtgttcatgagagatgttagtctttgttttgtttgttttctatgtaatttgtcagggtttggtatcaggctaatactggtctcataaaatgatttggaaaatgttccctctctctttattttttcaaagattttatgtaggattggttttatttattccttaaatgcctggtaaaatttgccaatgaagaactttcaggcctggagttttctttgtgggaaggtttttttaaaaattattattttaatctctttaatagatgaaaggcaattcagagtttctgtttcttcttgagtcagttttgatcatttgtatctttcaagaaatttgttcatatcatctaagttatcaaatttagatgatgtggacaattattggcataaagttgttaataatattctcttatccttttaatgtatgatgtatgtagaatctgtaatgatgtacactcttgatactgtttttgtattgtaatttttgtattttattcttcatcagccttagaggtagtttatcaatgtgttgattttttaaagtcagctttcaattttactgatattcactatttctcattttctatgtctttcattcctgtccttggtttttattatatttctctacttcagtttctcaacgttagcagtcttgacatttggggtcagataattctgttttgtgcatcataggatgtttagcagcatccctagcatctcctcacaaaatgccagtagcctcctcctgattgtgataaccagaagatctccagacattgtcagatgtgttggtgggcaaaattgcttacagttgagaaccgttgctcaacttctttcagtttagtttgttcctttttctactttcttaaggtggaatcttggatcattgattttggacactaccctcccaacagaaggatttaaagctaaacagttgtgtttaagcactgctttagctacattcaacaacttttgatatgttgtgtcattaagttcagaatattttctaatttctctgcaatttgttctttgagctgtgatttatgttccaaatattgggatttttctaattagcttactgttgctgatttctaattaaatttcattgtgattggagaacttactctgtatgatttcagtacttttagatttgttaaaaatcatcctttacaaagcacatttgtttgagatgtagtatgccaaaagatttgtcaaggacttacattagggtgtttgctatatttgaagtaagaattgatttttaaagaattcagtttgtatgctattaaaaaattttttcctgtttaccaaagtaaaatgtacatacaaaaaaagcatacaaatcctgtgtacagctcaatgaatttttacaaaagcaaagaaatattacaaatcttagaagccccctcctgacttttccagtcactgtcaccccctccccaaggtaactgcaattccaacttttttttttaattccaactttttatgccataatttagttttgccagttttgaactttatgtgaatggagttatgtagtgtgtactttttgtgtgtgtttggcttttttcattcaacattatgttgaaattgtgtagattaatccatgttattgcacaatagttgtagttagtttattctcattgctgtgtaatattacattgtatgaatatttcacaatttatccattctactattgatgaatgcttccagtttggggccagtatgaatagttctatacaagcattcttttgtatgtcctttggtgaacatgtaaacatatattggcttggtatatgcctgtaagtggaaatacttagtcataaagtatacatatatccagctttgatatgtaagttttaaggaaaaaggttattgattatagttattgttgtgcatcctgtttagatacttgatgttcgtgggcttagttattgtggtggtaattgttttgtcattgttaagaaagaagcaatacatttcttatgaggcattttttctaaaagtttatagtattcaaattttactgtttttaatggtttttaaaaatgagatgtacttttcgatggaaacaaatgcagaaaactaccgtcttaaaagaagaataataataaatagaagttttactgttccactaatcccagtatattttcaatctcaacccctttggtatatccttgaaagatacctgctctactatagctaaaattttctggtttttttgccctctacatgtatgtgtaagaattgtaagctttaggataccagttagttagaatttagctttgtagaatatgctcttttcattgtgtggagggcaacatctgtgaggcactttaggattagaaagtaagttaaatgaaaatgttaacaaagtagggattggctcattaattctgcaaaattagaggtcttttcttttgctagaagagagtattgaaattctggagtggggatttttattttctttccacagtggtactactcttgagccaaactgtaccatttcgtatagtttcatttctatggttcatttctttgactgccaccaaactacaccctaaataatcacaagtttatgtattggagctatgttgtagtcaatgaaaagtcacatatctggttaaggtagtcacatttcatagataatgactcccattcaaatagggaatacattaggatgcctctcttaaagggatgctgtttgcgaaaaagattacctgtgattcaatgataaaatgatagaaatgtctttgtcattggaagttgttaagtgttcagggtaagggtgtttgaaaggaagacacaattcattagtgtttgctctcagaggtgcattttattgggagaagaaaagtgggctaactagatgggttattcagaacatctcagccttacacagggaatttatcataattgaatatttcaatggaacattattggaagggcttggttggacacatacctcagagaagcaaaggggttgtttctgaatgtgctagtgtgtgatacatttaattacttgtttatcgcctgtactgtttggattactttctctgtgtacgtataattaggcatctctctctgtaatatactcctaaaccttgtactgtcctcacagctgactaaatgataaagtagcttcagtcacctatcttttctttcagtttctctttccatcattatggttgttgtttgcttatttccaggctaattcaaagtgttattgagaacctatcaatttgttgtcccatgtagtatagttaataacgttttgggtaacataattttagtcttttaaaaaagtaataaaaatactaacagtagctagcatctattaaatacttattaggagctagatgtttttacatctgtttctctaattctcacagtaacctggccaaggcatgtgtaatactccagttttacagatgaggaaactgtaaaccagcgaggttaaataatttgtctcaaagttacacagcctgtgtgagtgacagagttaatatttagattcatgactttctttctctaacaccatgggtctttatgatctttttgtgttgtttgctggttttgctttggacttcacaactcgacttgtttgcttatcttatcccttccacttggaatggcatctccttaacagtttcagactctactagtagcaaatgtacctattatttaagccttagaccaaatgccacccttctaaagcttttcttacagtgccatttggaagtaaactgtctcttttgagctcccacaatactttgtacctttctttgtatatttattttgccttcagttataattattgctaaacatatcttaatttacccaatggagactgtctttgatttcctgtagtgtaagacagccttgaacactgaaggtactcagtatttgttgacttgacattacaggtaaaaacccatcaaaataggagtaaacactattgatgcttttgtaaaaaaaattggaagaacatggcaacatggtaatgatttgtatatttatgatcatttttgcttctcgttatttgaaaatcttgctaaattttgctggtggtataattaaatgtggcatgcatttcctggtttggtgaaaaggttcataatcttagctatcattttctttaaaaaaagataataaagaaatgtctgtttggcaggcaggaagaacctgctgttttaattttgttcacagcagtgggtcagattatgatcttttggagctagctttgataatagactcaatataatattggaattcaacaattggttattgttgagtatattatctcttgcactgatggctgtcagtgggattgccagactgtttagaataagtttatggctgtttagaataagtttatggcaaatagtctgctcttctctaaatacaatgtttccatttattacttactgtagtattttatatgtgcattgtctttttgttttgtttttagttttcttctcagagagaggcaattaaaccaaaacttgctcaccagtgggggtggggaatcttactattgattatttattcaaattttgaattatattttttcttctaaacgtctttaaataggccttttccctcttctaacttgactgattaacatttaattcaaacaaagattaacaaaattttaaacacttttatggtgataaaggcacactgtggttataatttattgaattttgagctccgagtctctgttaaactaggatttctgactgtgcttttatagtttcttctatctgaattcttgaaacatcataagactctatttacttccctcaaaggagaagtccttttgttaagataatatttttaaatgaatatcagtctttttcatttcatgtctcttggacttgatgaaattactcatgaagcaaaaggtggataggagacagtaactcaaagaagtcttttggcccttaagctaagacagtgggtaaaagttacacaaattatgagaccagcaaaagcactcttaattttaaggtttgagaatctgattattaaatatccattgaaataatcagattaaagccataaatattctttaagcatttgacattaaccagaatctacaaaatgattaaagttttagttctagtgacaggaatttaaattctccttcataaaattcctgttgttgttaatgttaagttattgcaaaagtaacacatgttaattctagggaactagtataacaattctaatagtagctaactttagagttcattatattttgctatttagcataaacctgttagtccttataacaatcatatgaggcaaatactgttatttttcctatttcatagatgaggaaaccgagcacagagaaatgaagggactttactgaggccatacagtatttggactcaggcagtttggccttagagtctgtgcccttaacctctgttcagtattgcttctcactgagtggttaagatttggggattgttaagatagacctggattgaaatcatggctgccactttatactcttgggagaggagtatatttcttgacttctctgagcttcagtattcttgattataaaacaaaggttgttttagggataaaataagatatattaactgcttatcccactgttccccagatgctgtgcttgttcaatagaaggtatcatttaaaacaaataatgagaaacaaaaggaaaaaagtcaccaaaactaaacaataaccattgctaacatttcgagttatccagtcttgtaaaacacgtttcttgattttattaatatattttttctttatattaattttctttcatgtataactttttcttgtttttgtttcacaaaataaggtgggaagacttggatttgcctgtatcactaagcagtaacgcaagcctttttcagcttctatgctagccaaaacttttttttctctgtttagaagtgggtagatggagatagaggaggacatggaagtacacccacttttttttttcctttttaaataaaaacaggattatgtttaaaatttcttatataacatctgcagatcaacaaaatctaggatgctagaagtagggagaacatgtgctagtattacttttattaaaataacaatgaaactccagtttcagactgttaagagttgttaactgaaaatactatatttgtataaacaatcctaatgaatgtagactatttcctctcgatgagtgagcttgtagaagtctgaccatgtgttgcattgttaaataaattcactaggtgtagcatagcagtaactaatctgtctttctatagctttagcaacaaagcatggctaatgcttttttttttttttgtcttttagatctacacacaatgagctggaaaagaatcggtgagtcagtgatgaggtacagctttcacttacgtttaaaagcaaactcaccattttacctgtgaaaataatgtaatagtgcatatgtagttgtaattttatttttcagatgtatagcccattgtgaatctgatatatatgtattttctccaaaaaatgatttaatagtaagcttatagcagctagaagacataaatacatttttaaagcttactcgaatttgagttttaggtatagcctttatttctgtctctgaaaatgagttaattgttacaagctcatggtttaaatgtagttttgctaaagggtaggatttctaaagagtaggtaataagcattacaaattggagggcattgaatttttcttcctttgtaatttgttcattcattcattcatttattcatgcattcaacaactatttatcaaacatgagctgtatgtcagtgccaggcaggcagaatgctttatataggaaatacaagaatatatatgatagtttttgtccttaaggaattcagaactttgtaagggaaagacaggtaattaaagtactatataatgtggtaagtatggtaatggagaagcagaaggtactagagggtactgaaagatattttagaaggtcacctgatacctttttgaagggagtcttggaaagttctgcagaggatggtgagtgagcagtgtatactgaggaaactgcaaaaggttcagtgtgactataaaagattgtaacatgagtaaagcatgccaggtgttgaagagtcttgtctaccatgcccaagagtttagacttcctgagacccatagggagcagttaaataattttaaagtggattatcatatgatcagcctgtgtcttggaaatatcgttttggctacagcttgaagaattggttggttgggagaagggataccagaggcatgaagatgcttttgaaggctattgcagtaatctaggtaagagatgatggtggccactgagatagaagtagacaaagtaaagagtatggaatggagtcaatagaaattggtgattagttagctatggatagttgagtcttagatgatattactgttaatcaagaaaagaaatagaagaagaagacaaatttggaagagaacataagaattgtaagagtaaaatactttctttttggtgtagagattagattaatagcagccaggcatggtggctcatgcttgtaatcccaacactttggaaagcccaggtgggaggatcgcttgaagcaaagagttcgagaccagcctgggcagcaaagtgagatgccctccatctctaccaaaaaaataaaaataaattagctggtgtggtggcatgcagtcccagctactcaggaggctaaggcaagaggatcacttgagcccaggagttgaaggttgcagtgagccatgatcatgccactgcactccaacctgtgtgacagagagtgagaccctgtcttaaaaaaaaaatgagagagattagattaataacaaactgaaatcatatgtaccagctgtttttgacaaataagatctcatgaccttcaactttttgtcctccctttaacaaaaaatatattggctagcccaactgcctcattgcaagtaagtttaaatgtcaaatccccttgaaaaggcttagcatagtttttcaggcagactcagtggcttttactactttgcacagtgctgtgttcttgtctcttattgtaaggctgaataggtagcattgtaattatttctgccaaatgactatgccccaaatgcaaagatactgttttgttcaattttgtatcctcagtgcctagcatttgaggcatgtataggagacaatggctctagtattgagtgaaggataaaactggaactcaaagttgagtggtctagtcaaagacattttggtagttagtggtagaaactccttcgttttaaagaatcttttctgccttttatttctgatttattaaagatctggatggataaaggaaggacatatctggctattttaaacataacaaaaaagactaagaaatgaaacttctgaggctcctaaaaataaaaccttaaattgaagtttactctaaattagatcatagagtatgttttgggcccatggattaaatattgataaacatgtggcttttatagttatttcatttgaatgtggtccttgggagaccttcattggaaacctggtgaaaaccattaacactggactagggactctctttagtaactatttggaatggagctttaaaaatctttgattcagtgatgatgagcattttttcatgtgtcttttggctgcataaacgtcttctttcgagaagtgtctgtccatatcctttgcccactttttgatggggttgtttgtttttttcttgtaaatttgtttgagttcattgtagattctggatattagccgtttgtcagatgagtagattgcaaaaattttctcccattctgtaggttgcctgttgactctgatggtagtttcttttgctgtgcagaagccctttagtttaattacatcccatttgtcaattttggcttttgttgccattgcttttggtgttttagacatgaagtccttgcccatgcctatgtcctgaatggtattaccgaggttttcttctagggtttttatggttttaggtctaacatttaagtctttaatccatcttgaattaatttttgtataaggtgtaaggaagggatccagtttcagctttctacatatggctagccatcagagaaatgcaaatcaaaaccacaatgagatgccatctcacaccagttagaatggcgatcattacaaagtcaggaaacaacagatgctggagaggatgtggagaaataggaacccttttacactgttggtgggactgtaaattagttcatccattgtggaagtcagtgtggtgattcctcagggatctagaactagaaataccatttgacccagcaatcgcattactgggtatataccaaaaggattataaatcatgctgctataaagacacatgcacacgtatgtttattgtggcactattcacaatagcaaagacttggaaccaagccagatgtccaacagtgatagactggattaagaaaatgtggcacatatacaccatggaatactatgcagccataaaaaatgatgagttcatgtcctttgtagggacatggatgaagctggaaaccatcattctcagcaaactatcgcaaggacaaaaacacaaacactgcgtgttctcactcataggtgggaattgaacaatgacaacacatggacacaggaaggggaacatcacacaccggggcctgttgtggggtggtggaagtggggagggatagcattaggagatatacctaatgctaaatgatgagttaatgggtgcagcacaccaacatggcacatgtatacatatgtaactaatctgcacgttgtgcacatgtaccctaaaacttaaagtataaaaaaaaaaatctttgattcagttttgtttaatgcattttgcagattatttctgactcattgataacctttttaaaaaccctcacagaagatgtgtgcatcacccatagtattactttggtatgccattataagttgtttaatctagcatctagctgtggcataggtataacacatgtggttttattacctgggctgtgtgtaatctccaataaaagtcatttgttcctattttatttacttagatataagactttcaggctggtttcttaccctaccttacttcacttaaggcatgatttcctcatcatcttctaatagctttggaagtgctaatagatattctttattagcccaaaggactaataaacattgtttatttctcaaattatttcttccactctctctttactctttttcctcctttactctctctattccctgaggcttcattgaaagatgatatagaattaacttttccaagatatatttgtttttaaaagggatttttatcaacaaaaataaaactcgaatttagaataataatctgtaccctacttctgggaagttaccagtggtggtctggcaaaaaacaaaaatactggtagacttaggataggggaggtggtttagcaagaaggtggcacaggaatatttttaaaatttaaccctgtattatttttacattttaaggcccccatccagttctgtttaacagtcctttttaccaaggcatcatttttatttgacgtgttaaacaaagaaaagttattctagctttggcatcctttaaaataaatagaattttggctttacctttgatctgcctttgagtgtgatgttatatgaagatagtaactcactatgaaaagattagttttgtctttgttctgaaaagacattcctgaagtaattcatattccttaaaatttgccactttgtataacatattcatgtcagaaattgcttttttcctttttagcgtggttctgaaatcttggatataagcttctctgagttagataagctggaacaactgatacctcagtatcagttgttactgattacagtacattaaatacaaaaattagacaggcatggtggtgcatccttgtaatcccaacttcttgggaggctgaggcacaagaattgcttgaacctgggaggtagaggttgcaatgagccaagatcacaccactgcattccagcctcggtgacagagcaagactttgtcaaaaaaaaaaaaaaagaaggtacactaatagtgtttttcatactgaaaaatgaaactcactagtggtctatgtgatcatttagtgaatcattttgaaaaagaaatggaagaaaataccaaagtacactgcatgaagtaaagttaaatatggaattgtgaaacctgtgtatactggattatgatataaaatactgtgggtcatagtcaaaacctactactctggatataagcttctctgagttatgataaaaaacataattatttttattggagcaaatgcagtgagatttggagtaggtgattttaaattgctggtgaatggctaagtaattccagatagctatctcaaacaaaaccgtgagattgttgaagccctggggtctggccttaaggagataatagccaccaaatgttgaggttcatactaccagatctccgagggaagcctaatggtggagatttgggttttggcaggcccagagtagttggttgtgatccacaattaccccaggattcccatagcccattagggagctctaggtagtttcaggactgatagagaaattcagatttttttcttggataggtcttgggagctgatatctgcccaaatccttgttggttatactgagtatgctctagatggttcagagcatttgttacctatgtaccaaccctgtccccctaggcccacaacaggtcataataggcctaggagatggaggggaagcaaaatacttcagttgttctgcattcctcaggaacctatgtgaatcatctcatggtaaacttaatgagactttgagattgaagaattaagatattactttgcccattggcttatcttacagtttgggtcctttgccagataagacacaattcagtatcagtacagattttagattgcctcattgttttttcattttcttaattcaaattgctgatgatgttttagaaagaatcaacaactttggccaggcatggtggctcatgcctgtaatcccaacacttttgggaggctgaggcaggtggattgcttgaggccaggagtttgagactagcagggccaacatggtgaaaccccatctctactaaaaatacaaaaattagccaggcatggtggtgcatccttgtaatcccaacttcttgggaggctgaggcacaagaattgcttgaacctgggaggtagaggttgcaatgagccaagatcacaccactgcattccagcctcagtgacagagcaagactttgtcaaaaaaaaaaaaaaaaaaataacaactttaacaggactctgatggtcaagaaccttagtgctgactgcaggagaggccatttaaccttaaatagctgttattccatcaaaacaaaaggcttatccttattataactttggcaaagctagaagggccaaggagaagtgactaagtatttgttaaaaaaaaaaaaaaaaaaaaaaaaaagagaaggatgtctagtgagtagtaataggtattctccatataaggactttcacctacctctgagggaaaattggaaattagcatttatagagttcttactgtgttcctccactgtgcaaggctattacataattctgtaaggtagaaaggcagaaagtttgagtcaaagtgtcaaaaactggccattttatcatcatagctacaatttgaaacaagatggatacaaacacaaaacagttctaatcatgatcctttttgatcatgaatatgagagttacggttaatatcaatctttcagcaacaattaataaataccatgtgtggcatcatgatagatcaaatgaagtataagataccctattctattctagttaaggttaaggtcattatagtttggtatttatatttcacctttcagtaccattatctagttaagttaccagtaaatgtctagaaaggtacactaatagtgtttttcatactgaaaaatgaaactcactagtggtctatgtgatcatttagtgaatcattttgaaaaagaaattgaagaaaataccaaagtacactgcatgaagtaaagtgaaatatggaattgtgaaacctgtgtatactggattatgatataaaatactgtgggtcatagtcaaaacctactactctgggtagttaaggagaatgtatactgagccgtgaagaagagagataatttgaatataagaaaagaataaggaaaggagtcagtgtgagtagagccatggaagcaggaatgtagcatcataagctgtgttcaggaaggagtgggtagaccgtattgagttaaatagcagagtcttatcagattagtagtggaagatgaggctgaaaaggtggtttggaattagactgtggaatgttactgaatgccaagtaatttggattttattttattggcagtggtgaatttttgaggcttttgaagcaaagagataggcatgtacaaagcatttaaaaaagtacaatctagtagctgtagaagcagggagaccagtttggatgctttctgaagtagtccatataataaaaagatatgagtcagcactcaggtgatagaattgggaacagaaaggaaaacaaaggtctaagaaacactataaataaaaagtattttctgttaattggtactacttatttcttcacatagctgcaaaagttatcttctcttagtgcctactgcagcaaggaaaaaagaagtgatcttctcaaagaacatatcaaattgagtcatttctctatttacagtcttccattggcttctcactacaattagataaaatctgtggcctacaaagtgcaccactctatcccttctgtagctcttctgacattgcttcctttcctttctttaaacacagcgtgatcatttccatcttagggcttttgcacttgctgttccttctgcttggaaagccctgctctagttcttcatcattatttagttctcaactctcaggtcatctgcttagagaataataatcacctcctggtcacactctatcacattactttttatgtcgccttaacatttatatctgtctgagttatttattcatttatgctgtctgacttctttcactaaaatataagtttcaggaaggcaggactttgtcttatttaccctagcacatagcagtcattaagtaaaaattcattgaatgaaaaaatgatatgtgatagtagatttataatcaacatgttttcacattataatgacttcagtgaaaagtgatgaagatatatactcttgagagttcagttgacataataaaagaattttataataggcaaatagaaaatttaatgaattcttaagatgtaaataaattatatgagaaaacttgataagtaagaacagcttaaaggatttttaccatgccggagtttatcgtacttttttagaagcatatggactcatttagtcctttaggataccatacagtgcactaagataaggataggtaattttataaaggagaacactttatctgatgaagtttatgctatacttgtgggatctttattcctttctcatcccatgacttgaaaatggtaagcatttttacaaggaaaagatttgtttatacttgtaggcaagaatcctgtaaaaaatttcaaatttttcatgttagaatttttgatggattagttctgtttattccaattgtttggacacgataatgaatgcatttttttttctatactgcctatcgtgtccccattttacatggatgttttgagagagtgatggttttggtctgccttatcttagaacaaaacgtaagagtaaatctttatgactgagggttaggcagtgttttctcttggtacatcatcagactaatttaggattccttggcaggaagaacatatctgaaatcgttttcactgcctattttgtatgcttttaagatatttgtttaaaaagggcatagtttttttacacggtgtacacattctacaaaaaaatgtacacttgttagtaggaaagaaacaacattggtttgacagaactttctttaaaactcttacctcaactaatagtacttaaagggtatttgcttgcattaaagtcaggttgcagggttagggaagtcaaacttttattctaggtttgaaattaacctataacttcagctggattaaaagtctacagttttagattgggtcctgtaattttggaaagtttagtcaaaatcccattttagccttggtttttactaagatgcaaagggtattagtatgtctcaatatgaaaataccttagagtaactttctcaacctgataaacagcattaatgacaaacccacagcttatggcacttgtaatggtgaaaaactgaatcctttctccctaagatcagaaataaggttgtcaactttcatgacttatactcaacattgtactggagcttctacccagggcagttagataagaaaaaaaaaataaaaggcatccagattggaaagaaagaagtaaaaccatttctgcttgcagatatcatgatcttatgtacaggtatacttcatttattgcactttgcagatactgcattttttagcaattgaaggtttgtgtcaagcaggtcaatttctaatcgcatatgttcacttcatgtttctgtgttgtattttggtgatttttgcaatattttaaactttattataatttcatacgttacgatgatctgtggatctgtaatctttgatgttattattgtaattgttttagggtgtcacaaaccatgcccatataagatgcagacttaataaatgttgtgtgtgttctgatggcttcactgactggctgttgccccatctctctccctcttattgtccctgagacacagctatattgaaattaggccaattaataaccctacaatggccactaagtgttcaagtgaaacaaagagtcacatgtatttcactttaaatttaaagctagaaatggttaagcttagtgaggaaggcatgtcaaaaaccaggatagactgaaagctagatctcttgtgccaaatagccaaattgtgaatgcaaagggaaagttcttaaagggaattaaaagtgctactctggtgaacatccaaatatgaaagttaaacagccttatgggtgatatggagaaagttttagtagtctgtatagaaaccagccagaacattctcttaagccaaagcctaatccagagcaaggccctaactctatttaattctgtgaaggctaagagaggaggaagctgcagaagaaaagttggaagctagcagagtttggttcatgaggtttaagaaaagaagtcatctccatacaaaagtacaaagtgaagcagcaggtgctaaggtggaagctgtagcaaattattgagaaaatctagctaaaataatcaacgaaggtggcaacagattttcaaagtagacgaaaccatcatctattggaagaagatgccatccaggactttcatagctagagcagaagtcatagagaagggaagtcgatgcttggcttcaaagcttcaaaggctgggctgtcttaataggggctgatgggctgatgtagctggtgacttgaagttgaagccagtgctcatttaccattctgaaaattctaggcccttaagaatgaggctaaatctcctctgcctgtgctctgtaaatggaacaataaagcctgaatgacagcacattgtttatagcatagtttactatttgacgcctactgttgagacatactactcagaaaatttttttaaaaaattattgctcatcgacaatacacctggttacccaagagctctgatggagatgtacaaggatattaatgttattttcatgtatgctaacacaacatccattctgcagcccattggaccaaggtgtgatttcaactttcaagtcttattatttcagaaatacatttcataaggctgtatctgccatagatagtgaatcttctgatggattgggcaaagtaagatgaaaataattacatgtacaatagcatctaaaagaataaaatacctaggaataaatgtaaccaagaagatgaaagctttgtacactgaaaactattaatacaaaatacttttgaaataaattaaggaagacctaaatagatgaaaagatatcctgtgctcatggattggaagacttaatattgttaagatggccgtactttccaaattgatctatagattcagtgcaagccctatgaaagttccagcttcctttttttttgcagaaattgacagctgataatataattcatgtgaaaatgcaaggtacccagaataaccaaaacaatcttgaaaagaataaagttggagagcttgcatttcctgatttcaaatctcactataaaactatagtaatcaaggcagtatggaactgaccaaagaacagacttactgattagtggaatagagttgagcgtgtagaaataatttctcacatttatggtcaactaatttttagcaaggatcacaagacaatgtaatgtattttcaacaaatagagcggacacaactggatacctacatacaaaataatgaggttggatccctacctcacaccatacacaaaactcaaaatggatcatagacctgaattttttaagagctaaaacaataaaattcttagaataaaacataagtgtaaatctttatgatgttgcattaggcattggttttttacatatgacaccaaaaacacaaccaacaaaagaaaaaaatagacacattagaatttatcaaagtgagctgggcatggtggctcatgcctgtaatcccagcactttgggaggctgaggtgggcggatcacctgaggttgggagttcaagaccagcctgactaacatggagaaaccccatcgctactaaaaatacaaaattagccgggcatggtggtgcatgcctgtaatcccagctactcgggaggctgaggcaggagaatcacttgaaccaaggcagcagaggttgcagtgagctgacattgtgccactgcactccaacctaggcaatagagtgagactctgtctcaaaaaaaaaaaaaaaaaaaaaaaaaaagaaatggccaatatacatgtgaaatgcttaatatcagtagtcattagggaaatgtgaatcaaaactataagataccacttcacagttactaagatgaccatctagggttgctcaccaactttgtagtcatccattcatcataccagttaccactgatcagagaaaggtcttgaaaagtccactgagtttgcagtttggcacttaaaaactgataatgtcatcatcagctgatggcactgcacagatggctcaacactttgcaattacttaagacatgtaattaaccacaggtaagttttcaatatattatgtggtgccagtatgtaatgtggtatgagtatttaataatggagaaagattagtctctatttagcatatgaaaagaatatacctttctttcagctggaattaccgtcttccagtaatttaccaaaataacaaacataaagggaaagaggaaagactcctgatatacgttctctgggtttcttagaaaacatggaattgttcctttggccacagacatgcgattctacaaaaaagatgatattgtagatatcaaaggaatgggtactgttcaaaaagaaatgtccacaaatgttaccatggcaaaattggaagactgcgagcatgctattagcattgttgtacacaaacaagttaagggcaagttttttttttggttttttttttttttgagacggagtctcgctttgttgccctggctggagtgcaatggcgcgatcttggctcactgcaacctttgtctcccgggttcaagtgattctcctacttcaacctcccaagtagctgggattacaggcacccaccaccacacctggcaattttctttctatttttagtagagatggggttttgccatataggccaaactggtctcaaactcctgacctgaagtgatccacccgctttggcctcccagagtgctgggattacaggcatgagccactgcgaagggcaagattcttgccaagagaattaacatgtgtattgagcatattttttaagcactctaagaactgaggtagcttcatgaaatgcatgaaggaaaatgatcagaaaaataagccaaagagaaaggtttctgggttcagctgaagcaccagcctgctctatccagagacgcgtactttataagaaccagtggaaagatgcctgagctgctggaacctattccctgtgaattcatggcataataggtgtttaaaaaacaaacaaacaaacaaaaaacaaaaaccctctggaaaaaaaaataaggggggaggtataggttttaaggatttctaattaacaatgaaatctaacaaaattaagactagatattgaaagaatttactagttttataaatttcatttaacaaaattaagactagatattgaaagaatttactagttttataaatttcatttaagatgtaacagaatataacttgattatatttgttatgccttgaacaacaaaattaagaagtatagttgtggaggaaaggaaaaacaacattgtccagtgatcaggaagtagctactgatccagttttctggattttatttctggcaaataaaaatggtggttacttcccatttttagcctaaaggtagaaaattgatacccatacttttaattattgcaaaagtcctgaagaagataattatattctttgtacttttttagacagtaggagtccagttgcagggctgaattatagagggttactgtagaacacttatgtcttggaaagtaggggccactcatttaattgaattttcttatgaaactcttagaaagtaggtgacactcatttacttgaattttcttaggaaccggataaatatgtaaattaacattatcaaacagtatgaagaacagtatcatttatcagagagctatataattcatgtatttctttttgtatgcaagtaaatgaatattttaactgtaatttctatagggataggaatactgaaaactgtagaccaactaaaaatagttgtcagagggcagagataggcacctgttagagttagaattgaatgctatatgagataaagatgaagtaatgtgcaggttttagagataaaatagaggaaatgtagccaggataaaattacacatctaaaatgcagtctgtacaatgaagtcattgcagttgtgtctagatagattcacagtttctatactgacctttgttagaaatagttcattaagactaagctttcttctccctgacctaggttacatatacagcaaggtgacagaggctcattcggagacaaagactgaattgtaggaaccaagtgtttttagtacttcagctagccagttattaaagtttaaagcaattctacaactgatgtgtgggaagaaatgagattatgagatcttaaaaaataatcagaagtactgtaacttgaaattcagcttctaaaattttgtatagaaataaacaaataagtcagacattgaataattgacatggtatattatagcgaagttgtggtagctttttatgcaagtgattgcagagtgcctaacttaagctgtaacttgtttaagaaaacaattcttctcaaactatgaatttgtaatttaaaaaaacaacaggaagagtttaattaatagattttcttgagatattttagatgatgcaatgtaaacaaatttattttatatgcagctttgaggaatgtgtttgattcataaactgactatacctttagtactgatgcttgtaataattacacaggagaatcctactagactttaaggcaatatgttattttgctaaattcttttgctgcatattgtaaaggaatttgtccattgtaaatgctgtgataaatattgaaaattgaatagtaagcacaattcaaatactttttcttaaactagaatcttcttcatttaaagataatttctattctggtacaaattttggcaattaaagcatgccaagaggaaaatcagtaaaaaatgtctttttattagatgagagactttgttagtatcttgcatttatattctaaaaatgaagagattcagatattttgatatattttagctgttttgaggaagaggataattctttacttcttgcttatctttttctacttattctagtaaataatgtcaatcccatgacagtgaaagtcccgtaagtgttactagtgaaaaactttaggtctaaactaggattcagtaatgacaacagaatttcctaatctgattactagctaaccagttctttaagacgaatttgtttggaaaataattaatcagcactatgacaaacacatgacatagtgcttatactcacatcttctaaatcaagaaaagttggaacttaactcataagtaaatgacttccttgttttgttgttattttgggaaaagccaatggagaaagataggttttaatactaaacatgattttggagccaaattgtcaaaaatgatacccagaatccaacacagatggcccttgggagatatgtaatgcattgacatgagtatcgtaccagaagtcagaagacataatttttcctttcatctctactactgataggttgtgaatgttgtataagttaaaccacttcttggagtcttgcttttcttggctattaaaggaggatctctagatgatcttagaaatccctgcctacatgtaaagttttgtacagttttgtgaatttttgagttaagtaattattggcatattagaaacttagttgttactctgctgtttctgaagcattttccttgatacaggtgtgtgtgtgtgtgtgtgtgtgtgtgtgtgtgtgtgtgtgtatacgcccacagatatatacatatatataacacttgagacacacacacacacacatgaaatgaaagaccagcaggaaaaatcagcttagaatctcacttcatttaaaatttggtactttgtaaatatctaaagattattataatacatggtactgtagctataataaggttttaatttataatgaagaactttgataagtagtaaatatttatataagactagaatttgccctaagaaacatatatttgtgtgtatactacaaacacattcctcaaagctgtgtgtacacatacacacactcatatggatagatatagatacaaattctgaaatttaaatgctcaggaacattcaggaccctgtcccttttggaaaactacttaccactgacttctaaggaaatgtagttaatctggtaagcattattgtgttataacttctggccacttttttgtattctctgacaagtttatatttgctcaggctccagaaatctggttttgtggttgtaactgtattatattgttgtatctcatcagtcactttaataggctccagtgatcactggatggagtgagccatataccaggaggaaagagcacactgctcttacacaaaacaaggagcacagcttagctcatctaaaatatttgtctataaacaatctgaagagaaagtagctacaggtcagtatgttggaatctttcttcctaaccatttagacaataaaagtagcttttaaataatgtcctcactgctttgataatctgccaagccccattcctaattctaggacatgtctactgtttattttttttgcttgcagagttgctaagcgttggaaatgagagctgtgctgactgggtccactagatagttatgctgtgtttaattgcagccttctatggattggccattttcacttctcattgtccccctgtagcatttatcataatgactattcaaaccattttttttttttttttaacccctccaagagagtgtgaggcaaaagccaaagctctagaggtcatcaaatcatattgtggtttacagacaggaccttagttcctctaaaattacgtgatagagatgaatgatctttaagatttcttctagactaaaaatttctgctatttgaagtacccaatcccactttttactcttagatctagtttttgaatcaatggctaggacccatatctcccatctcctagtctaaagatatttccagtataccattgtgactcttcatttctccctttgctgaaaatatggatgcctggtctgagctttttcatcttctcctatattttctacctttataacttcagctcagattgactatatactccccctgccttgtgaacttctactcatgtacagataggcatgaacaagaataacaaaagtgtttataataaaaattagaagtaacatgaatttctgttaacaggggaatgactaaataaatgatgatacatccataccatgtagcaagtaaaaagaatgatgtagatgtgtatatgtgtatgtggagagatttccaagacatattaaatgaaaataagcaaattgcaaaatggcatttcaatatgatctcatttatgttaaaaaataacaaagcaaaatcacatacagttggctcttgtatctgtgaactccacatccatggattcaaacgactatggattgaaaatatttggggggaaaattgcatctatgctaaacatatacagactttttccctgtgtccttattccctaaacaatacaatataacaactatttacatggtattcacattgtagtgagtattataagtaatctagagatgatttaaggtatagaggaggatgtacataggttatatgcaaatattacaccattttatatcagggacttcagcatttggggattttggtatcccccattgatactgagggatgattgtatttctatatgtacatgtatgtgtatgtaaatgcatcgaaaaggcacacctcaaaagagatgtcagatggatacacttttgttacttctggggaaaggagtgagattcaaggggaaacgatcatgttgattttattgtcatagtttctgtagtaagagtgcattaatttgtgaacttaaaaaaagattttttttgagccacttagtttacagtactttaaagtaagatttttaaaaaggcaataggtgtattctattcatacatttccacagataataaaggtgggagagaccttagaagatcatctagtagagtactgaaaatctaagtccctgtaagtaatatgctctaccagtctggttaatgacaaagtcaggatgagaaactaggttttctgattcgcagaccagagttttttacactaccttcaagatgcacagctaagatacataatttttcacaaagtgtttcctgattatccaaactgatctctctaaattcctatctcagattcactgtttgtgtcacttgtatgaattttaacccatactactttatactgttatttcctccctttctagatcatttatattcttgctagagcatatatattccatgagggcagaaactgtaacttgcttgtctttgtatctgacacggtgccttgcacttagtacttaaggtgaattagtaaggaacatttctgtagcaggctctgcacctttcgttagattcagagaaaaaagttgactttggccaagtcaaataaatagctgagttttttttgtttttgtctttgctggtaaaacctgccatgtcgagatagaaaatattttaggaaggcacatagtgagatatttgctaccctgcaaatatattccctttccaaggaaaatagttttgttctccactcctgcttcaaagagaacagtttgtccccatagaatattctaggtaatatgacccacttaggaaatatgtggtgattgtgcttcataatgggacctctttgctaaagttgtaccatgagaaaatgcctcttgagtgcaatggttttacagatgaaagtacattttttttctgtatttgaattggtacagcagaccaagaaactccattgtgacttcaagtttactataattagcatagaagctgtgacagatcttttctgttatgaaaacctttccttagaatttttggaatttatacaagtatctggcccttgaggtgttgttaccctgttctgtctaaatagctctataatttgatatagcatctttgtagatttcagcttgcttttcgagatatactcttttctatgattttcatctgcagttgtgttaatcctattttccttctgatttttttgtttcttctcacagctatttaatttgacatcatttaaggcctgtagaattatttacagaaatagaatctttcatggaagtttccatgatctgctggaacagtgatcttggacagagccttaggaagacccattcctttttggaaagctaattgtctctcttagtttagaattaatagctttaggaaaatatctcaggatgttctaaatttccatacatgctgctagctacagagattgttattgaagtggccaatgggttcatctggagccatttttctgttaccataatttaaaagtgtgtgtgtgtgtgtgtatgagagagatacatatacacatctttttttccacaaaggtatatgagttacatatatgtgagttctgagtttgattcatttgaaggctgtgaagcaattagagataagaggttattaaaaagaaagtaatttataactattttagtgagtttcaaatatggtataccaaaacttgttcctgctgtattgggcattgtattagaaattttgaaagtagttttgtttagcacattctgatttgctgtgcttagaaagaaatatattagtaattgattttttttttttttttgagatggagtctcgctctgtcaccaggctggagtgcaatggtgtgatcttggctcactgcaacttccgcctcccgggtttaaacgattctcttgcctcagcctcccgagttgctgggattacaggcacccgccaccacacccagctaatgtttatatttttcatagagacggggtttcaccatgttggccaggctggtctcaaactcctgacctcgtgatccgcctgcctcagcctcccaaagtgctgggatgagccaccacgcccgtcctagtaattgatttttaaatattcttgagatcataaaattttaaacttcatccagatgaagatttcttatgtagattaatttactcaggcaaattcctgttaactttatcatattatttttctagattttaactggctttataatttgccataataaaattccattcatttaaaattgtagtcaacaatgttttagtttagtattagttgaatggaatataaaaaaattgatttttaaacattagcttgaggctagtgctggttagtgctttatgttaaaaattttttttttttcaaatggtggtcctcgatggagaaatgttttctagaaatggtatacagaactgtattctacttctatttaggattttttagttcggatatgaaaaagctggagctcaaatatatgtttgagtttggcaccttcaatttgcaaaatggacacatctttcttgacaggtgaaggttttgatagagctctgagtacggaggagttagatgctagtacaggcccaacattggttaggaataaataatagttaagaattgtttatcttttagcaacagttttactatattcaataaagtacaatttggctcctctctctgactcttcttcctcaccctttgcactttagatgacataacaaggaaatacgttaaaactttagatttagggtttgtttcaaacttccttgattacttgatcttgaaaatttaggatttgttttgaacttcctttgattgtcaatctagggtgacttgcaagtaatgggtaattatgctaatgtctcttaacagtcttatataccccaagatgatgttttctgatttgaaatttttggtggaaatggagttcatttgaagtggtatagttcctgacactgacagaggacttataaagataattacaaatcaactgacaagcacttattagacattgtgtgctaggtaatgggaataggataaaagaagtagaagtcctgagccctgctctggaggattatagtctaggtagaagacaaaagatattataagctcctataagcagcatataattaagtgctaagttgtatgtgtttgagatgggagttgaggtaaactcatagcagggggttatcacgggctgaggctaatatgaactgcttagacatgagtggttattcctctgcatggttctctcttggagtttgccgtaattggtttttatcatgttttcagtatgtttaaaagggctttcaggagaaacactacatctgagtctcttttgctcttttaatcattatagttgtcacttactctggggtgaaagtgaacttgcagcttttcagcatggataagatagatataggcctgagagtacatttggagaatgtgatacaaccttcttactaatttatggtcgcttttctggtatgtctctgatgacagctaaaatacagagtctttttcttttctttctttttttttttgagacagagtctcgctcagttgcccaggctggaatgcagtggcatgatcttggctcactgcaacctctgcctcccaggttcaagcagttctcctgcttcagcctcctgagtagctgggattaagggcatgtgccaccatgcccagctaatttttttgtatttttagtagagacggggtttcaccatgctggccaggctagtctcgaactcctgacctcgtgatccgcccacctcggcctcccaaagtgctgggattacaggtgtgagccaccgtgcctggcctaatacagtgtcatttttaatggctgtgttttctatgaaggagtgtctacaatggttctccctctttttgtggtggcaatgttggtgaatgcccaaatgtcttgtgaaaacaaccaaaagcctcaactgggacagatcaatctatcattacctctgagtaaatgaggatacctgaacatccagttccttagccctccataatttcttagaggtcattgtgttttggagtactattgaagatgtcaactttattctagcaggccctatatgatgaagagcctactaacttttgagatcatgtatttcacgttgtacattatattttatctgagtgcttctcatcctttaatagagaaccccaagcaagatgtttgcatgggaaatcttgtgccttttaaaactttctgcctgctttagtgcatcaacctgtgattattgatttttaaaaattttaacccataacctatctcttataagcttccctaaaaactaagattgataggggattttatgccattacagaaaaatatatgtttaatagaatcctttattttctgatacttttatcctgaagtaactagagtaaagctgaccctttaaaatctaaaatcaaatgagaaagatacaggctttctaatgttgaagtgtaatggctaaattaagataagggagaaacttggaaattaggaaaaggtacacttagatttcttcatcagaaatcataatgactaaaatgagggtgtctattccctttgaatcctaaaagaggaattctcaaattaaaaaaggcagtcttaatacaatatgtggtaactatatggggacttactaccccaataaaaaatagaaataaaatcaaaccaagtttagatcagttctttgataaaatattgctattgggctttagtaaggagatgttaggggtatgtttctgtaatatattggttactgtcttggaggacagccatcatagttttttctgagccatctgttggtgtcattgtcaaaagtgaactctttggcatttggaccattgatgcaaccaaatatgtcatttttcttcagaattgtaatgtttgtaggctttttccatcttgattcactttattccagcctgattcacaattattcctttacagaacagcttgtattcgacaaagctgtgaaaaaaatcactcttctctaaataaggttctttttttgattagaaatcccatctttgcagttaaaacatttgtaaacataacacaatttagatagagctgattgacttttcaagactgctatttttataatggaaaagaatttttcttaaagaagcaatttggtgatggggcccttagaatgtccttgaaaacagctggaatttactgctagcatatattgggtcagatgaatgagggagcatgggtttggctgatttgcaatgttcaagaaatattgatattcttagaagacaatacagaatatatgttgggtcttattttccaaaatgtcaaagtgtccttcatatgccttttgttctgtgagataacagttgttggtgatcctgaaagatgttttagaactttcatcctgcagtatctgaaaggaaatgtagccaagattggaaaatttaacctccatactctactggcttctttagttggagtagtggtcaatatgttcttgctgttggaatatacttaggcgagagagccacacaacctgcctgatgaacaactaaaatattgactggcaatggtaacaaaataaaacatgttcccctccacctgtctcttccttcttttctcaaatccctggaactgtatagatttttcagggctgttctcctgagctattgatgaaatgaaaataatagcacttgtgtagcagtccttagaaaactgtaatggtattgagctgaggctggaatcatataaaataaatactagagctttgattcctctctcatttaatcttttcctgggcttttctagaggagagtcaaactaagatttagacaaatataaatagaagcaagtcacacagtgtaatgttgcaacccagatataacttgaacccagtcttttacttgataaagaggagataattgtaattgttgttaatctatcaaacacctttcccttttcagaagggttttaaaaaataaagtagttcttaaggcatgttcactttctatctacctaaaagtgctaatctgtaagtgccctactatatataacactgagaaaatttctgccttatcagaggagggcatgcccaggattggtgccaggtgttgtgttatgctaggctgcctccaaaagttactctcaaaaactactcttcagttgggccctttgtggtcaggaaaaaaaaaaagtgatacagtataatgaaagagaggtcaaaacagttaagtaatttagaaataaaaagacataccaaaacattgattctctattattatcagggactatggcgtattttaaattctgtaaattttatttttccagaggttgcaaatggcctgtaaatgcttcagttattaacaacaacaacaacacatacacacatacacactggccaacaattcctctttgttaccctttttctactgcaaattttatctcctcctcaccaaaaaacaaactgcattttgattttgggaaaattgttctaaaatgggactttaaaaataattcctggctggcttgactggattggcagatgtccagcaatgccaaaccatttgccatctgccagtagtaagcatggttaccacttttaatcgtttagctctctatttcaggttgctcatattcagtacaaattatgaatattcgccttccagggatgaattaattcttgggccagattgttcctgttccatttaataaaatgtctttcctcctatatgaatattccccttaaaatgagctattatacaactcacatcttattagtagggccacttttaaaggtgctttgctattttcattttctgcttctagatgaacagctatattacaaagcattctttaaatgtgctgttttgtgctatgtaagatcaccattttaattagagatcagtaacagtatttcgtcatttccctcttccatcctggacaataatttgatacaataaagcagttacactgggctctgggtgggaatagagctgtgagagttagacttaaacttttgtagaagagaagacttaattcttgcattttgtacataaaattaggtcagtgtcttgtagaacattatcactgcgtctcagatctcacttgccagcacgtaggaagtttgttttggtttcaaaatgtactttaccccatggtggctggcagggtacaatactattgacatcactgtgtttcaaatagaaagttaacaagtagctactgttgtgattgcagattgccttcccagtccctgtgagagaatgctttttcttttggacagcaacacttctcagccccttggtaccattaaatcagccaatgggggctgccagaatagagatgaacaccaacaaaaggccaaagagtagaaaaactgttaataaggcaaaaatctttaatcagtttccaaattgatgtgaaagataattaaaaaatattctctcccatcgatggctaagttttgacagtagtccaggttcagagcctgatctctctagagaggagtatcccttccctctacccagacccctggaaagttgccaaaggaaaataagctattttgtatttagaacaaattgccactgttttctccagtgatgtagccctatttcccagactttgaaacttggaatacagaaagttcttgtgtgaccaaagaagaaatatggtgaatgaatgatcaagtttttctttttaactaaatccttataaacagataagagaggggaagtatgcatagaaactaaatttagcacagaatggatgtcaagtgagcaatttctgttaaatcactttggagtttgggttccttgtgggagttccagtgaagaacaaatgcctctggaacaagatttaattatttttttttttttcaaatgaggctgtcaaaaatgaagtcttccttagacatgaatgcaggataattaaaaaaaatagttgtttatatgttctgcactatagtcttcaacttagcaagcagtccatggatctggtaagcatacactagtttctcatttattacatgggattaagaactgttgacttaatttttttcttctttgcattgtggaatattgctttttagactttcccttctcataccttggttttcttagctgtttgttttcctagtcctaggcccctttcactgtaaatactttgataaagtcattctgttgtaaaagctgcagttcttaaaccctttgcttcactattaaaaaaggtgttggccggttgcggtggctcatgcctataatcctagcactttgggaggccgaggcgggcagattgcctgagctcaggagtccgaaaccaccctgggcaatatggtgaaaccccgtctctagtaaaataaaataaaaaaaaattaggcttggtggcacatgcctgtaatcccagctactcaggaggctgaggcaggataattgcttgagcctgggaggcggaggttgcagtgagccgagatcgcgccactgcactccagcttgggcaacagagtgaaactacgtctcaaaaaaaaaaaaaagtgttgactctcatcaagagttaggttggagactgttggttactctacatgtagacatctttggtggtatgcaccttattaacatttgctggtgatttcagctgcaccagaaaaaaaaaaggttaagagttctggcattcataaatagatctctcacaaatgctggcctggcatctgattatactgtttggaggtcctggtgttgattgttacctcaactttggtgagttagagagtcccagaaacatccactagaagtattacatctctcctccccactgtgtgccagtcattctgtttatttgaaaaacagaaatgactaaaagtatggattcactctcaattgaaatacagtgtgattagtatgaaatcaagtatcatctgaggaaggagtatggcaaggatgatcttgtggaagaaattgtttggccatggcctgaaaatgagttagatgcccaccaggtggacatttggagagaatgcattccaggtagagatattggcaagtataaaagcacatttggttatggaagaggtttgcaagggtatgagttatgggaaatgaggctggaaaggtggtaggcagaggactaaattatagtcttcaaacaggtaaagattatactactgacaacttgaaaaatcgttatagcatttagctcagtggtataataaggcactattgtttactgatgataattgttattgactgagtggcacttcatgttcttcatatttctgagttgtaaagactaaatgacatttcagcctatgtggtatctgtgtagtttgagaaagaatatgtgactattttgtcatcattaatttacatctccctttcctctctcttccatatcttctctcccttctcccctgtcccttctttttccctctccaaacctttgagagacataatcccagccatgagtcaaaaatgatgttccaaagtccatagtgatgtgttgtgatttgctgtagcagtttgaacatagattcctggaggccctgggatgtagtacaggttgagcatcccaagtccacaaatctgaaatgctccaaaatctgaaacattttgagtgtcaacatgactctcaacagaaatgctcattggagcatatcagacttaggatttttggatttgggatgctcagctgagtataatgcaaatattccaaaatctgaaaaaatgagaaatccaaaacatttctggtcctaagcatttcacataaggaatactcaacctgtctgaaataatatgaaatttgaagtcttcttttaaaaacacattttgcattatctgtgtttgtttttatataaaatatttttcttccaaatttttgaaaaaattatgacttctggaaaggatagtataaccctgtggcttcaaatatcctctggctcagtgttgaatacctctagaggtatatatagcctatgctaagaactatttatattttattgaaagaaagtggttttaaaaagtctcccaagaataagtaacatgcatctcaaccattttaattcttatttgtatacagataagccctttcatgctgaggctgacaatgtgacagaataatttatattattatattatatattatatgtaatttgtagaatttgcagctttattataccacttgttaatatttctatttgattattttataagataccaattaagaaggctatttaagtgaaagctgcttttttgaaaagtgagaagagagtcccagctattttcctaagtttttatttctgtcatcattgagtcccatgactaccacaatcagatctgacactagggacctgccacttgccacgttactacctgggagttaacagtctgtttattttctgtgaagtagataatatatgagttgtaggtgaaacatacgattatcaaatgccattttgtagaaatagcttgtttagcttttttttttttttttttttttgtgagatggagtctcgctctgtcaccctggctcgagtgcagtgatgcgatctcggctcactgcaacctccgcctcccagtttcaagcaactctcctgcttcggcctcccaagtagctgggactacaggcatgtgccaccacgcctggctaattttttgtgtttttagtagagatggggtttcaccgtgttagccacaatggtctcgatctcctgacctcatgatccgcccgcctcggcctcccaaagtgctgagattacaggcatgagccaccgtgcctggcctttgtttagctttcttatttcatgaaccgaataagctgaacagcagaatatgatcatacatgttttagtaaataaaactcatgaaccacaatatgcttttgatatatcaggatccatttttaatgtcatttttcattaggaaaacaggcaggcagggttttttggggggataaatttgggttttcagaagattctcaacacattaagttttagagacactttggtatatatgtgtaggaaaagtagctagctgctgtcacgtgcaggagtgtgtgttgggagttgagaaacctggccacaagccactgcagctttgaagaatgtggctcatgagaggactcatagttcattacgtaacattcagcagagcggaaaatataagcactgtctccatcacttgacttgctttccattttgatttagttatctggtaaagtctaggtatcctatagtggaagaatgaaagacaagcaggttccaatgaaggaccatgcttccaaaggcatcagccagtggatcgtttgtggggccaggcgggggttagatctattattgttggacaggggtattagagttttgaaagactacttgaaaaacataatcaaatgatacttggagtttgttccgaaagggtattctttcctctctcttcccacaacagtgtgcgcttcctattatagttgatatacctgtgctttaaaatagcacagctactagtagaggccattttataccaaaatcatttcccttcatgttctgtggtacatcagtttggcagtagaggttacagagtttgaaatcaaaaggagcattggttccttcagggaaaaatgataccaatctaccaaaataaaagccaaacagactctcattgttctttatcccacaaggggcttgccctttttgaaggtgtggttaattttgataggactcttctctctaacagggttagtggctgggaattaccttttcccctgggcaaaacccactttaaaatctcattttaaaacagaactcaaagtgtctttgaaaataaaagtactttgggaactcttcattgtgtaaccccatccctctcagcaaggggactccagttttctcacagggcacttcctgctgcagtacctaattctaactttgttttactataactcatgctaaaataggaaaggtttcagctttacagtttttattagctgttcatgtgtttttaaaaagtatgtgttaaataaaaataaagtaaatgtccaccaaggagctaaatttttaaaaatcagtttccattaagtctagttctataaatgtttcagtaccaggttttttctacttgctgtttgtctaatgttcatcataatattcagaagagcagccttaactttccccaaccttctttcccttcttttactagaggtgcaggaccatgcctttcatgaatcgttattctctatgtcagctcttctctcccttggagacttgaaaaacatcatcatatgatacttgcagtttttttcctcagtgaataaggattttttttttttttttttttttggtggagtctcacactgtcacccaggctggagtgcactggcgcgatctctgctcactgcaacctctgcctcctgggttcaagcgattctcctgcctcagccgacagagtagctgggattacaggcacggaccaccatgcctggctaatttttgtatttttagtagacacagggtttcaccatgttggccagactggtctcgaactcctgacctcagaagatccacccacctcggcctcccaaagtgctgggattacaggcatgagctaccgcacccagcctgtgaataaggattttcaaatcaaaccaagcttttttcttctattgcttgtcctttttccttcccccaaagtcttacagcacccatgatttggcagcctcatacaggaggctcttgagctaccagtcacatgagaatgaaggcaagaaaagaagggaccagatggcatcaaaagatatgcctttctaggtcactggtggttaagcttgcaatctggttaccaacagggagacttatgggggaaagggtggagagcagcatcattgaaaaggaagaataattttgccatacaattgctgttctaagaatttgcaggagagaaaaaaaacttagacactgaggagaatcgatttttctgatttaactctttccagtttacagttacagggcatccattgctcttggaagggtacatttacctaagtggcagctaaggacatgtggtaactgtgtgcattatttggatgggactctccctcttggtcagctgctgttcttcaactgccattaaccatttgttattctactctccaaatgcctgtttcatttaaatacaaaaacttaaggaaatgacatgtatcttccacaggtacacctctgtccacaagagcagaggaaataattcactgttcatctttcatattaataccgattttggaggactgtatttacaaaatatgaagaatggcatcactggcctttgtgagatatctcagggtatattttcttggtgtaagctgtatctcagagcagatgaataattatttgacaataaaatgttcagtagtggctaaaaaaaatatcttttagagcattctgccttccctgttcatttaggcatttttcaaactttggtctgggtacctcctgatttgtcggtgcattgcagatcctcagacagctgaaactagctgattatttccatatagaattccagctcagttgttttcccttgaaggagagaaaataaggcattttaaattttatgtttaaacttggtcccagtctataaatttaggtcctttactttttaaattacctagaaaatcctcgctttttcatacacaaattctatattattcaagtccaaagtcaaatttgaacctcttttacaggtctacctcctccaattacaatctctccatttattcagattttttcaattttatgtttaaacttggtcccaatccataaatttaggtcctttacttttaaaattacctagcaaatcctcactttttcatagacaaattcaatattctttaagtccaaagtcagatttcaacctcttttacaagtctccctcctctgattacaatctctcgatttattcagattctgttgtccttgatatctgtatgactcattcagtatggaccaaatgaaacaaagtaatatgtttctttctgtagtcttgagtgtaaactcttaaagttaacattttttttttacttttccttctcaagcaagtgtctggaacagtgctgagtatgtaaaatccatgtaataaatacatggaatgattaaagagagaaaaaattttaatatgttagttattttcattctaggttttagcaagtatcacaaaacggaaaatagactcacctttcttttccttgatgtgaaagtttatggaatcattttgattttcctttctttcttttcttttctttttttttttttttcttcctgaggcagagtttcactctgtggctcaggcagaatgcagtggcgccatcttggctcactgcaacctccacctgctgggttcaagcgattgttgtgcctcagcctcccgagtagctgggattacaggcgtgcaccaccatgcgcagctaacttttatatttttagtagagatgaggttttactgggttggccaggctggtctcgaactcttggcctcagtctgcccaccttggcctcccaaagtgctgggattataggcatgagccaccatgcccagcccattttaagtttcttaaaaactaaaaaataaaagataattcttacatatactgaagttttggagttaatttgaaccaaattgacaaggtattcttgcggtaatgtgcttgttaactttactagttgctttgttgagttttttagaagactgaatttaaagcaggattgtctattagtgtagctgccagtctttgtttccacgctccagtcatattatatgagtgcagttgttatcatatgccataataatcttaatgaagagtttaaaggcactttttactctggtgttttgttgttgttgctgtttgtttgctttttttggtctgctgagcaagagcactgtggtcacatgagaatcctcacctaagaaattttccagttaaaaatgaaaattttgttaaaggttctatgcatttgggtagtacagcaggggaggaaagtgactttgaagttgttaaatatcattaaggagaatccattgatatacctttgatttagggattcctttatccacaccagttacgtcaggtttcagcctggacccaattattagacctgaggtactgaactcaataaagaaatttgaaatggaaatactgtcagacctttaactatagttaggttagtaggtgctagaagaatcttaattcattagccaaacctctgacctcactacccttaatcatccttgcttgtcatgacataattggctgcttattgccttctcctacctctcttttcaaattgctagcctttgagaatttcacttgacattatttcttgtctattaagacagagaaagcgcatagtttggtgtgtgaattagcaaaaccattttagtcctctttcagaagagaatggagggtgtgtgttttgttcttgatgcagttaagacagttaccaaaagttcaattataggtctttaaggactaggggtaaactgtgaacgtatttgtggattttcttttcagatatgctgttaactgctgaattaccttaccccttatgaaacacaggaccaaagatgtggactagtattgttttaggatgaagttaaatactcagaactctctcatcaccatgatcatagttcttttagggcacagggaaggtaaatccatgaggttctctgctagcatttctaggagaaatttccctcaactttcccacaggaaggatagattagagaatgcaatgactttcagtaagtaatttttgtcacctgttgtccttgtggattggaggcaggtagtgagagagacgagagaggaagagaaaaaagaaataaaaattaagctaacgagctagcacacttagataggaagcaggggattattttatgggttatttctgtggctagaattgaccacagggcatatattttgtctaaccctaccctagctggtcacagaattttgctgtttctgttgtattggagtataagaaatcaacatttttataagtgaaaagtggttgaatatcagaaatttcatgtggttcaaactaatatataacaacatgtaacacactgtaggatggctacagttgtagagaggtagggtgtgtgtgtgtgtgtgtgtgtgtgtgcccacacacgtgcaagcaagtaaaaggtgggaggggggaaatagaaacttgtgagcatattatattcccttggggtaccatagctgaaaacctctcctctcgcctgtggttttagttattcaagatcaaatacaattgtcctggtatgttttcacacttccatattaatacagttgagacagtttatggggtgagttaaaaaataaaccatcttgacagagattaccattggggataataatctaaagtgagtgttgtctaaagagtacaacagaaatagcagagactgaaatgcggccacccctacattctttgacagtggagaattaggggtgtgacatctatcctataggctgaataaatgcaaattattgtttatcttaaaataggttttatgatatttctagtgaaataaccagactgtgctgatttgactttttgtctttcttagacgagctcatctgcgcctttgtttagaacgcttaaaagttctgattccactaggaccagactgcacccggcacacaacacttggtttgctcaacaaagccaaagcacacatcaaggtgagaatttttactttcagatttgcacaattccctcagttctggtttaattattggcactgattcctattcatatacatcagctagttcaccatgccctccttaataactgacctcaagagaagtctttctaaaaacttaccagctaatctgatgggaacaacataacctgattaaactaaattgttttgacagcgtggccatttgaagaactgagaacactaggaaaataacaattaccctcttcatactcggaaggcagttgtgccctctggtggagatgacttcatttggctgtgtccttccgtatttttccatcaaataccatactagaggaagtttctccgtggagattactttacagacttttagaagtccatcttgttcaagtaacatagcattcattacatacacacaaaagtaaagacaaaactattttttatttttaaaaatatgtatttatatgcattctcattttggaggctttaaaatgtatttatatatttttatacacactcacacatgtatattcattcatgttttctctgctaaaggaggaatcagttttattgtttgtactggactatacacaaatgtaaaaatcatttcatcatttcagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgaggtaggcagcttgcctcttctctaatgaaatactaaacatctctgtatctggatttagggaaggtatgttgggaggcactgtatttgctttctttctagccaacagagtaacattgtaggttttatgcaatcataatattgtctacagcagtgccagtgtggactataaaactttttgttttttccttgaaaaaaaatatatttatatatttatattataaattatataatgtccctcaatttaggtttgtctgatgttttcaaatgattagattgagggtatacagttggggtaaggaatatcacagaaatgatgttgtgcccggtggctcatgcctgtaatcccagcactctgggaggccaaggcgggcagatcacaaggtcaggagatcgaggccatcctggctaacatggtaaaatcctgtctctactaaaaatacaaaaaattagacgggcgtggtggcaggcgcctgtagtcctagctactcgggaggctgaggcaggagaatggcgtgaacccgggaggcggagcttgcagtgagccgagatcatgccactgcgctccagcctgggcaacagagtgaggttccgtctcaaaaaaaaaaaaaagaaaagaaatgatgttgtgcctttctcaatccattgtgtcaggaagatacacgatgtcgaagtttttactactggtgatgtgaatttttatatgtagattttaaagtacaacaccctttatttctctttccatctatcctagaatatttatctttgacagagttaaagaacagaagtcaaccaaaaaagaatggtttgaattttactgattgttcttcccaaagcttccaccacatcaggcttcatatcacattaaaagatcccagaggtgaacactggtgatttgaagtcttacatttggagaaaggagctcatgagctctttaggattctaaaacatgagacaagtgacagagtttttttgtttgtttgtttttaggactctgattttgttttttgtttttgacttttttaagtggaaattttcaaacatacttagaatagaataatgaactcctgtatacccaccattcagtttgaatagctgtcaacttgtttcatctgttcttcactacgctcaccctcaatattttttctggaatgctttaactcaaatcccagataacatcattttgcccctaaatactttagtatgtatcttgaataaataggatttttaaaaatgtaattataatgctattataataccccacaaaattaattcagataatcttttttaatatcatctaatacccagtctgtgatacattttctccagttgtctcaaaaatggcattttaccattggtatgtttaaatcaggatccaaaggccacattgcatttgtttgatgtgccttttaagatattaatctataataattttttctcttccccctacaccgttttggtagaaacaaaaactgatttctacataacatctcaaaaagacttctttggcagagaaaacatgaaggaatatataggtatagatctgtgtgttgtatatatgtacatatttttttaaacatcaagagactgagtcatttttcttatagaatttcctacatcctagatttggctggttgaatcctcatggtgtcatttaacatgttatgtcctttatattgactgtaaactggttggtagatgcagaatacttcataggtggtgctttgtacttcctgttatgtcagtattgtgtgtagttgttgttgcacttttaatattaatcaataggttcaggtaaggtcattttaatacatttatataaatgtatagcctttaacttaacagttttagcaattattgcccttatttcattgggtgtcataaaatagtgattttctaattgtgtcattcctcttgtatttataaactgtttttctcctataaacattttctcatcaacttttcggttatcctgaaataaagttcatacagggaaggtgggataaatgcttggtcttggtttttgctttatcagttttccaaacagagttggtaacctagcagcttccagaagtaacaagttttggttttactattttttgattatatcatgaactcatgttttgctgtactgaatgtgttccaatccattgcagtcatccttttaaattcttttgaatgctcaaactgtcccagatttgctgagtaggagccttttaaatagttttttcatcctttttaacgcaacctttttaacacaaccctaggagttcttgtttttctgttttgttatttttctatgtaaaagtttatttttgtgtggcagttttcaagaaaagtctaccagaggcagtagcaagaacctgaagtacatgctacatttatcagtaacagtgaaatatagcagaaataaccctgaccttggtgtcccagtctttcctctattgctaactagcggaaacctcttcttaggtctttaggttttagctgtccttcctgttacctcctccttgtacccaccccaactacctccaaatttcagagaggagggtgtattttcatcactatagctctcatttttttttagtgttcccagtgtaccttactttagcggtaccttaccaagtaccatccttatcctgagctggcaacctcctttttgtagtgttatgggggcttttagttaacatctgtggtacacttggctaaagcagtttctcattttactttgtttttttgggtttttaaaaaatttttttaaacatatttttaaattttattaaaatagagatgggccttgttgcccaagtggtctcaaactcctgggctcaagcaatcctcctgccttggcttcccaaagtgctgggattataggtgtgagccactgtgttggccatcattttactttattttgactgagttcagcatgctcttttggatagtgtgccttgttattatcttctagttgtaggttggatgagtgttcagtggtgctgggaaacaatggcttctgaagcaattcggatatagagccaatatatgaattcacagattatttggacagctgcctacattttaaaaacatctctagaatctctaaaacttttgaagcaacaagcccttttgaaaagtatattcctggaaatagcttcaccctgtccttttggcctcacaagaatccactttttttttttttttgagagagagtgtctcgctctgtcgcctaggctggagtgcagtggcgtgatcttggctcactgcaacctctgcctcctaagttcaagtgtttctgctgcgtcagcctcccaagtagctgggactataggcgcgtgccaccatgcccagctaatttttctatttttagcctagacacggggtttcaccatattggtcaggctggtcttgaactcctgacctcgtgatccacctgcctcagcctcccaaagtgcttggccgcacccggctgaatccactttttttttttttttaaagcagttgtgattagtgtgaacccttaaaaagtcagtgccaaatgtgaaacatcaggctttgaatttaagtaaggtaactgaaaaatcctgggtttcactctagctctgatgggagaaaacaactttttaactcctttttgtttttaacatgtgtattgatttatgtatattattgatgattgaatatctagtatttaacaattaagatttttttttttatttttaagagacagggtctcactctgtcacacaggctgaagtgcagtggtgagaccttggcacactgcagcctcaacctcctgggctcaagagtgatcctcccaccttggcctcccgagtagctgggactactggatcacccactatacccagctaatttttgtgttgttgtgttttttttggtagaaatgaggtctcactttgttacccaggcttgtctcaaactcctgcactcaagtgatcttcctgccttagcctcccaaagtgctgggattacggacgtgagccactgcgtccagcaacattatctattgatagctgagtcaaatatgtatttgtggtgttttttttttttaatgtttggcttttaagtctgtatactaccaccaaaatggatctcactataatctgaagacttttaagtctcaggcccttatttcaagctatatttgatgcaagaaaattaaatctaagacatatacctcaaactctactttataatgacttgtttgactgactagttgaagatctttatgatgaatcctagaagtctgttgaactatctgtagaatggcaccaccaaaggcttggatgggtaaattttctagtttgcctatattaagtttatgctcctgcccaccctttaaggcaaccctgattaataaacagaactgagaattagtttgtggtttaatgcaaaacagatgtttttaaaccacttgggggttgggaccttttaatattaagcactaattcccaaatacgccaagtgctttagggaggtccagacggactggcgtcaaaggatttaggaaatttgctgcctaaattaagaccaccactgtatatcagacattccccttggcaaaaaatattcctgtctcttcaccttgttcctctgttctccagacatcactgataataagcttgttgtgtaacatttcttatacctcttttcctcatgctgttagtttttgaaggtgcgctatactcgataattaatgttcttcttttttttttttcctttggcagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 206 - DNA, 324 bp, Homo sapiens
atgtggctgtccccatggtccacatgccctccccaccccctgcctagctgcttgactgcctgctgctccccagcccaccagcctgtccgtgggtcagcccagccacccgcttcggatctctgcacgtgtgtcacctgctgttctggccctcatcccaactatccacctgcccatctcctccctacctcctcgctgcctatctgcccaggacttatctgctgtctgctcacctgcctgcttgttgactgcttctctgccctcctatctgcctgtgagactagagatttgtcaccttggaaagcacggagagtactgctaagatga

SEQ ID NO: 207 - DNA, 11936 bp, Homo sapiens; identical to SEQ ID NO: 102

SEQ ID NO: 208 - DNA, 176027 bp, Homo sapiens
agtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcaggtgagtcggatgcagcgccgcgtcctcgctcccgcggcggcccggaccaggcctgggccgtgatgactagttctggggtctgctcctggccttcccctccccagctctcctctttctcaggctcctgtgccccgcgggcccctcctggctcccttggctgtcttctgcttgcttagactacttgcagagttttaaggtacgaaatacactgctcgctcaatcctgggaatctaagctcagcttagggtgtaggagaaaactgccttaagtctctggggcttgtgccctttaagccattccgtgttcatggagccagtcagtcgccctgctgcctcctcagtcacacgctgtcctccttggttcgccccttgtaagtgtttttaaaataaagtttttcgctcggtttgaatattggccctgtgctaaggatgcagagcattctgttaacatgtttgggcagaggatggaaaggggtgtagggacacaatttcagaaggctttttgcactgcggaatcgtacctccccagttacgattaagatagtaatcgtatctggatttggcctatttcatacaattacaaagcccctttaaaaggaattctcgctaaactgttctggagtcctaacgagtagcaagaactattgcttctgtaaaatgataactcatcatgttaaaatcagatttttttttttttttcacaaggacgtttgtaggaaaaagtatacccgtaaagagtgaaccaaacacatggaacttgtagtcggaggatttttaaaatggaggacgaaggtcaggttgaggaaatagggaaaattatctgcagggaagttttgctccccccccccttttttttttctttttcaacctattttgtttccttctttgctttatttttcgtctcttggccttttttccctttaaaccgagtgattacttatgatatgcttgtggtcctaccctgagatgattatttattttgatgttttataatcgaatgtgcacttcctaagcattttattgaattttggggtggttaggcattgcctgcagactgggctcaggtaagatacactaataatgttactccatgttctttgtttatttagaaacatttaaacaacctagtaggaaagacatatgttaaccttttgggtttatgttaacattaagagaaaacatcttagcagtggatatgtatgtgaaatctttggacgatgtggagcaacattataattctgtttcacagtcacctgtttctctgaaaaaggaagtgaaatgttcagctgggtgtgatggctcacgcctgtaatcccagcattttgggaggccgaggcgagtggatcacaaggtcaggagtttgagaccagcctgaccaacacggtgaaaccccgtctgtactaaaaatacaaaaattagctgggcgtggtggcgcgcccctgtagtcccagaggctgaggcaagagaatcgcttgaacccaggaggcggagtttgcagtgagccgagatcatgccactgcactccatccagcctgggtgacagagcgagactcatctcaaaaaaaaaaaaaaaaaaaaaacagaaagtgaagtattcaacttggttataattaagattatgatttcccaattgacttgcccacattcttcattgttagttttggaaaacctgtttgaagacttttgactacaaaagactacaagatttttatacaagataaaaattagggaattgtatcaagataaaatttgtaattggtaagcaaagactaatgttaataacttgttgttttcttttcttttctttttttttttgagacagggtctcactttgtcacccaggctggagggcagtggtgtggtggtgtgatcatagccaactgcagcctcgaactcttgggttcaagtgatcctcccatgtgagcctcctgagtagctgggactacaggtgtgcatcaccacaccagctcattttttttgttttttgtagagacaaggcctcactctgtttcagaggctggtctggaagacctgagatcaagcaatcctcctgcttcagcctcccaaagtgctgggattacatgtgtgagccaccatgcctggatgtgtttttttttgtttttttttttttttctctttaaaattgaccatattggttgattattcaaatgataagtccaagtcatctacatatgagtgtacagtaaaaggcaagtgatgtaacaccataagtaacatttgtgttgaaaagatttggccccagaggaaggataattgataaattaagggaagtatttgtgtaagatttagatatgaaatttgaactggaacactggaacagcagaggatcatagtatcataattgaagtgaaatgctgacaggttcaatttaccctgggttttggattttttttttttaaatgcttaagcagaagaagtgatcttaaaagaaaatactccctttatcttcaaattctgggactcttcaaaaacaaaattaagagcagctcatcttaaacaggttcttcacatgagttggaggggtgaactgaaataatttgaaaaacaaactagcagagatgacacttgaataattagagttgtgattaaaaatattgttccaccaaagttatgattttagaattgttgtatgtaaatagtactagtaagttttttccctacgaaattactatcttaatctcaagagtctctgttcttatgcagcctttgaatctactttctagtactaatatttaatattttcctctttaaaaccaattatatattttaagtattttattagtatatgttgaattgatactatatttttattcttgttattcttagtctcttcatgtgagtatcttcatgtgagtatgtttaatctgtctgcctcagattttaggatctgaggggcagaaagcgtggattctcactttttgtcttttctcacaaattggctcttctaaatttaagaacaaaaactttgaaaaacttgaaatacaggtatgcttcacaatcagtaaaatattctagataacagtttccttagtgttgttaggctttcaagactgtccattacttggctggcccacactctaatttatctccatctcctggtcaagagctgggccatctctttctcctagttctcaccagtaacattcccactcaggtgaatcccctgtgttccctatacccctagaaggtgggtttagccaatttagtaagtaagacttctttgtcattgttacccgaatacttcctgtatttcttaggagaacaaaaggagatcctgtgaatgtggagtttcaggtgtttgaaggtcagtgtagcaagtaatcaaaaaaagattgataacaaaggtggtcagtttgtattaaataaaggaaagaacagtcactgctatagagcaataaaaaatgtgatctgtagaatgtggtttgaccataaatacattttgcaagtatttgagtagtttccattgctggagttcatctaaaatgattgctattgaaataaagtggagatgatagatgcaaaggcaaggtaagtagacttccaatgtcaagatattttataactttaaacataagacagcactctgagcacttatttttagtttttaatgaagaggatattgttacacgcagtgaagaataaatgatccactaatcagttagtgagttagattttttaaaacaactttagtgggatataattaatataccatacaatttgcccatttaaagtgtacaattcaaggtttttacttatgttcacagggttgtgcaaccatcatcaaatctaatttcagaacattttcatcttccttaaaagaaatgctgtacccattaggcccttcactccctgacccccacccgctccagccctagtcaactaccaatctactttctgtctacgtaggtttgcctgttctggatatttcatataaatggaatcatacaataggtgttcttttttgttagtggctctttgatttttgcataatgttttcaagtttcatctatgaaatctgtacttcattttgtttgtattgctgaataatattctgttttgtggagtgaggtcagatttcacaaaaaaagtcttcaaccctttgttctaccctctggatgtttacattagcaaatctctaagatgtagcttctggttgctgatggaactcgtttggctttgcagtattccaaggttctcctaattcagtagatagtgaggacttaaaaatggcatggaatggtgtggttctcctctggaaaaaccattcatgaaaacatgcatcaaaggattctcaaaatcacaggtataatcacaatttctgttttcacattggttaactgcacagggttaacctcaaatgactgaagaatacttgtgtaactagagcttattaatagtaggtgtctttctttaacaagagtttgtgatatcacatgatttgaagaattatatatgaaatgttagttatttaaattgacaacccagaagaaatattaataactatcatttattgaatgggtgcttgaaatgtgccaggaacttgagattatttttaacctctttgagctgtgctccgttgtccccagtggacagaggaagaatcagagggtttagtaaattgctttcattatctatggtttcatagctattaaattgcagagtcaggatttgaaaccaagtcatccgttctgcaacattcgtacactgtatgttggtgatgggcctacagactggatgagtactcgggagtagatttctttatacctacaaactttattaaaagctttttgattgaagacacactttcactttttaaaatttaaatttttgttttatttttaagaacaatctcagaccaaaaaaaggcacagtttcaaatttgcacattcatgatttttctggaaggattgcagaatagttggcacattttgggatcaagtagcttgggattttcttcagatttgcaaccataaatcttgtcgtatgagaaaatactggaaagttactaaggtgcttaacaaagcaaagggtttgacagtcatcagaatggtgggatttgacttcgaatgctattttctgtttatcgctctggcattcttgaatggatttagtgactccctggaggtccagcttggtaaatgtcatatgcttgctgttgacattctagtattggggtatagatacctgttcttactggcgagccaatgttgatcgcagtagtcattacatgggttatgtttttcgcagaggcagggaaggtgagggaaggcagagaaacaaacttagtcataaatgtttttgaatatttgtttattctgccctttggctcccgaaagggagtacgtgtgcctaaatggaaaaagttctgcagattaaagttggcagggcaactttcaagtactagtgctggagtctacataagaggaaacagatgcaactgaagattggacctaaaagcatacctttatttgatttggaggaaaaaccaaagagggaggtttcctgggattacagatcctgagtttacattccctgaatatctttttccctcactcccctcccgactagcccccattgctcccaccctgtttttttttttttttttcctgttctttctttctgtgcaacactaactttcctatttagaggtcaaacttgaacttggagacccaaacctagacttgaattctagcttccctacagatttcataggcttattgtgaagggtaaatgagaatacttattctctgtaaaacagatagtacataagtgcttgataacttgttattattatagtattattagccttagtagcactgtgctctgattacctgagctaattgccagggtagggtttagaagaaagagttgatatctgggtgactacattgtcagataactgagattaccattgctacttgcaactgagagtgttgagctttaaaactaattttttgttgttgttggttttggttggttgaattgaggataatttatttctttcagtttcagaaaaatttgtcagatttacataacaaaatttataagtttagaatgcatgggtaaacggatttgaatagatcagtttcagtgccattaaaagctatttgtagataaggataagttaaatgtatattttaaaaacagtgcatcctttatttcatttcccttcttgtcactcttagcaaaacaacatgtagcaattcatatgcatgtcatctgggatggattgagattaaggttagggaggcagggtgagcaaagccctcactgggcttggtggagagtatgacataacactattcatttgcccatttatccaccacaaatactgttgagtgctaactatagaccttataatagtccaatgggatgacaaacagtaacaaaatgaataaactgtgctatggtaagtggtgagaacaggaagtatttggtcctatgagaatttgtgagggaaagttctagagctgtgctggggaagcagtgcctcagctgagatctggcggttgagtgtaagtgagcaagctggagtgacaggaagggcagagggaagaatgttcttggcagaaggaaaagcagttgctaaattcctagggcaggaaagggcagggccctcatgaaacgagggctgagtgacgagccaggaaagctcagatatgagtgccatggaactggagaggcaagaagggcaatgagcagggccttcagcctttatcctggagcagtggaaagcagttgaggtgattttaagcagaagggtaacactgttgtgtttgcaactgtaagccgaatttcttgtttctatgacttccctagagttattgccggccctctttgggaaaacattgttacacagagatagatcagtctaggtattcagataaactcagttaaaattgccttttttaaaatgtcaattggctgggcgcagtggctcatgcctgtaattccaacactttgggaggctgaagtgggcggatcacttgaggccaggagtttcagaccagcctggccaacatggcaaaaccacatctctactaaaaatacaaaaattagccaagtgtggtggtatgcacctgtagtccccgctactcgggaggctgaggcaccagaatagcttgaacccaggaggcggaggttgcagtgagccgagattgcaccactgcgctccagagtgggcaactgagcaacactctgtctcaaaaaaaaaaaaaatttaatgaatacaataaaatgggaatttatgctttttgtaagggatgctacttttgtgcacttcttagttatcatctctcagagaccatttctgtctgggggaaaagtctgatcactgtggtatgggaagttcttctcttacagggactgagtgatggggttattgaaacactgaaactaggttattgcgttgtcatggtaactccataataccatggtgtggtagttgagaagcttgccacaaatctgtatcagaaagaacgctttgttttatttgtcgatttttgtctacaaaacaatgcgtttgccctatctctaactggcaattccaggaaaactatccagtttctggaaagttatctttgccaccatttagtgaagttatttccatttaaataacctagtcattgtggaagagaggaagggctagacagtttaagaacttgaacaattggtgcctctcaagagtattacattgggaaacagtatagctaacaaacagattggctttggagtcagtgggcaagctgtgctgttactaagctggttgaccttaggcaaaaatagttaacctctgagcataacttctttcattttttagggggatgatacttttcgggattattatgacaattaaatgagatgtaaatgaggttctagtatagtccttactgtatttttatgaatattaagtaacatatatttaagagcatcatttgtttgtatagattactcttattggatgaaaagggattgttgaaactaagaaataattgtagttcactcagcaggtatacacttgaaaatctaaaattatgaacagaccaattaggagatgactagtgctactgcagaagaattccttgcttgggtaaaagatttactaagcagttcctttatatatagatccccttagtgagtaaatctaagataggaaggacttcaaaaaatttggttatttataatttttcaattacatttgtaaaaaccttagagttatctttaagtcttcaccacatgcagccttttaggaaatcccgttgactctgaacttcaaaatatccagaatctagtgagttctaagccaccacagactcttgtctctctaataacaagtttcttatctctctgcttccaccttggctctcctgcagttgattctcacacagcagccacagtgatccttgacaagctttggtcagattatgtgatgctctgcctagatctctctagtggtttctcacccactcagattaaaactcagtatttgtctcgtggctttgaataaggctttattttattttattctattttatatttatgtttatttttattttttgaagctgggtcctgctctgtcacccaggctggagggctgtggtgtgatctcagctcactgcagcctctgcctctcaggttcaagtgattctcctgcctcagccccccaagtagctgggactacaggcgagtgccaccacaccctgataatttttttgtatttttattagagacggggtttcaccatactgaccaggctggttttgaactcctgacctcaggtgatccacctgcctcagcctcccaaagtgctgggattacaggtgtgagccaccgcacccggcctgaacaaggctttaaaccacctgcttcctgcttccattgacctctgacctcatctccactactcttactccgttccacccacatacacctcttgctgttccttgaacaaccttggcattgttgctttggggcctttgctttttcctcttcacggaatgctcttcccccagatatccatgtgactgacccttcttactctccttcaagtctttgcagaaatatcaccttttcaatggaaccgcccctcctacctataaactcacagtcgtttctccctcactcccactcctatccattaccctgccccacttttcctttttgtcatagcacttgtcaccatctcccctactgtatactttgctcatttatgatgtttctgttagaatgtgagcactgtaaggcaaggatctttgtcttttaatctcaagcacctagaacaatgtctgtacacagtaagtgccaatgtacctttgttgaattaatggaaatatctgttaagtaaggtattcatacatatatatatatatatatatatatatatatatatatatatatatttttttttttttttttctgagacagggtctcactatattgcccaggctggcctcaaactcctgggctcaagcaatcctcctgccttagcctcctgagttgctgggactataggcatgtgtcccagctgtgtctggcttccagtctttttaatattaagggataatgatttttgtgaattatcttctctttttacattctcttatcagctacaaatctaacaaatattagcggtttcccaacctctaagaatgaaattatttaatctaaaaatatagagtaacctcaggacgaagttctcctaatacagactctggaactagattacctacttttgaatcccagctcagctagttacagtgttatcaccttaacttctgtgtgcctcagtttcctcatctgtaaaattgggataattatagattggaaatactgattaaatggggctaactgatttaatgtgtgtggaatacttagactactgagaacactacctgacatttcaatgttaaatactatagaaatgatagcagatattatctgatgggatgattctgattttatccacatgcatcttttcccgactttccctcaaatttctaaagacactgcatattcccttctagatgattatcaaagtcgtcaattttagtatgtctaaaatttagcttttctactctccccagcgtgttctggacttccttatttttgctaattatgtcatcgtcttgctagtcatgaagctccaaatcagagatggcaaattctgatgcctcaggcaggtcaagtaaaatgagtgaagtggaccaggtgtaatgcatgtcaagacactgtccaggtaaccaggcatggtctctagtagcagccttcagcaacactggcacagtcctctcagattttcaccagcagcccaaatctagattttcatatagaaagtttcttaattgtttagagttgatgcaaatttctcaggtttactctgtggaccaaataaattatgtcagtggctagatgcatcaagtagccagtttgctccctcatctctaagtcttagaatcatgctttcctttgcacatctagacaggaaattgccaaatcttgctgaatctaccactacagtctctctcgcatccataccttcctctatgttctcctaatatattgcctccctaccaaatcttacactcactctggcgcaagtttaatctaccagtgaagcctccaatcaagttaccccttccttataccttacacatacaggtcagaagtttcataatgtctatgcaaacatcaggctccttggcccttttgatcttggccttgtgtctgtttctgatgtcacctcctttgcacccttccttggatgcatcctggatgacgtcctgtgtcccagacatgcctgtgctttcctgcttcttgcagcctccagggccttgcttgtgcagaggcatttagtaggttttggtggttgttgcatgttggcctcactctgcctgaggtgctctttctcatattccacactcttcctcactcttcctgtttgtgaaattctactcatgttccagagtgtcaattgtgactttttgcattgagagctttctagatgatagtgactgtgcacttttggaactctaatagtatttcttgtattcattctggtgggctttttcacagtttaccttattagtcgtgtgtatgtatatgtgtgcatgtatcacttcatttgctcaaaagtgtatttgcactataatatttcatgagtgaatacttttttccttgaggttctggtgtatttcaattggggggtcagatgttttgctttagttttctattttttgttctactttgcaaaataatttgtgaactgttttttctccttcttctgaaacctcaagtgctatacatctaaaaatgctagattgaaaataaaccaaggctggttagacaaagctggttacagagttatgatagcagggctgtcatactagttttgaaaatgtatagtgcactgagatcaaaaagatgtccttgaatagtattggtaacaggctaacctttcttcatctgtggtatcaggaaattacagggagttacagggaactgaacactctgccatatttaataaacattaaatataaatttggtagtatatttattattctttcccaaatctttacaaaattgttgtgagtagattttcctttagtaagaaagatttctccaattaaagttttagtaacaccttgctaattggtaaggcttattggtaagactaattcgtgaaaaattaaattctagagtgtgttgaccaaaatgtagtttttaattttgaaattgtgataaaataagtccataccttctggaactaccattctttttgaattgttgaagactctggaccaaattccctggaaaatctctttgatagtaaatacattgaatagtaagcatatagaaccagaaactgctataaagttaaccatagagcattgagtatatagtttatttgcttcatggaaataaatgaatactacagttggttgacaatttttacacaagtttagtcagccattttgtgaaaaaacttgagaaaatgaaaaaaatcaggaggcagaagagaatcatgatagaatagcagaactggaagggatgttagcaacctcttcacttcaattattagggaaatacatgctggaaaaggtaatgacttgcccaagattatgcatccagttagagaatggccaggccagacagttcagtggcaaagggcagaagtggtggatgcatctgtggtagattgattaaaagcaacgataggagcgatgagcagcaggctctgacagcaaagtggaagagatttgtctgggttgaattagaggaaagtggtgaggaggaaaagcagaggtgatttagtgatagtgatgaggatgctggcagaactggacatcatcacacattcctgaaactggtatgaggcaagaaacagtcctctctatacaagagcctaaactcttaaagaaatgatatgtacctttttagcccttaaggatgccattatgccatgctcttggtacaccctacatagatgttaagaccaggaggcacttgttcattgtatatagtggtgcaagctaagttagttgatccaatatctcctacccagagtctcagctgtgcttatatcccaaactactgattatgttgatgacacttaattcccaaggaaatactgcatttagtatatgttcctcaaggtggccaaaaaagaatatagtattttttagaaatttaaataccagtgtaaaaaaatcctttaatattcctagtctggagaaaacttcttcagattgattttactgtaatgactggcattaactgctcataaccaagctaacttccagtaggaatattgtcagctttgctttactgatagctgagactctagtcctgtagaagcagtactcatacagtagacaggttcccctgatcttgcacatccaatcttataattttgccgtggaacaggaagctactgcttatctgtgtgttccaatgcctatcactgtctgtcatgtgtaaggaggcgatgatctccttacagataacgtgaaaacaaaagccacattgggctagacaacaacattcacacattctgaattagagcaggctgatttaataaaatgttactgtaatggtgacattttaatttacagagcccttttcaagtattcttgaattatttccataacaaccctatgaggcaggttagggttggttttgttatttccatgtaatataccaagaccagatggagatgcagtgactggtataagggttacacagatagtaagtagcagaagaaattgaatctaggttttctgactctaggctccatgttctttctaatttactgccaaagctgctaaataagggtgattttaaggccatttggaatacttgcacatgagcttacaagttggagaatttctcaaatgttgcttcaaagtgaaaggttggccaggtgtggtggctcatgcctgtaatcccagtactttgggaagctgaggtgggaggattgcttgagcccaggagttccagatcagccagggcaaaaaaaaagaaaaaagaaaaaaaatgagccaggcatggtggtacatgcctgtagtcccagttactcagatggctgaggtgggaggattgtttgagccccggagattgagggtgcagtgagccatgattgcaccactgcacttcagcctgggtaacagagcatgaccctgtctcaaaaaagaaacataaaagttaaaggtctgtttatatcatggcagtattcaaattcatctggatcatatgaatcagtccagtgtgctcattaacgttacattctagggctttactacagacctacagaaaaaaaatctgtaagaaaagagcatgggaccatgtatttttaacaaataagatgattcttaaggtcatgcattttgggggccaggcacggtggctgacacctgtaaccctagcactttgggtggctgaggtgggcagatcacttgaggtcaagaagctctagaccagcctggcctggtctagtagagatggtgaaaccccatctctactgaaaatacaaaaattagccccaagtggtggcatatgtctgtaatcccagccatttgggaggccgaggcaggagaattgcttgagcctgggagacagagtgagactctgtctcaaaagatcatgcattttgggaaacactggactagccctagaaaaaacagtggattatccatgcaggctttttaaccaaatatcttctgaataccagggcttggtttataatagtgagccaccgtgtccggcccagatgggtttttaaaaattatctttattggccgggcgtggtggctcgtacatgtaatcccagcattttcggaggccgaggcaggtggatcacttgaggtcaggagtttgagaccagcctgaccaacacggtgaaaaccggtctctactaaaaatacaaaattagctgggcgtggtggtgcacgcctgtaatcccagctacttgggaggctgaggcaggagaatcacttgaacctgggaggcagaggttgcaatgaattgagattgcaccattgcactctcgcctgggcaacaagagcaaaacttcgtctcaaaaaaaaatctttattatgaaattaatataaatgatatcttttaatgatgattcttaaagaggcaatagactgaagaggatgttctaattagtcttcttcttcttcttcttctttttaagccttttaaatgatgaggaaggaggaaaatgggcttaggttctaccagaagaaatttagattttagttggccatctggatgacctttgtagtaattaaacagtcagattgggtcattccttcagcagataaataaataaatacatatatttctaacttttattttaagttcaggggtgcaagtgaacgtttgttacataggtaaatttgtgtcatggaattttgttttacatattatttcatcaccgaggtattaagcctagtacccattatttttcctgatcctctccctcctcccaccttccaccctccgaaaggcccatgtgtatgttgtttccctctatgtgtccatgttctcatcatctattatagttcccacttataagtgagaacatgtggtatttggttttctgttcctgtattagtttgttaaagataatggcctctagttccatccatgttcctgcaaaggacatgatcttgttcttttttatggagcagataaatattcattgtgtggtgattatatgctaggccctgtgctgggtatgagaatatagtgatgagcaagaaagccatggtctcaaagttctgatatccggaatctacaagcaagttaaacaaatttataagaaaaaaaatcatcaaaaagtgggcaaaggatatgaacagacacttctcaaaaagacatttatgtggccaagaaacatatgaaaaaagcgcaacatcactgatctttagagaaatgcaaatcaaaaccacagtggaatatcatctcatgccagccagaatggcgattattaaaaagtcaagaaacgatagatgctggtgaggctgtggagaaataggaacacttttacactgttagtgggactctaaattagttcaaccattgtggaagacagtgtggcagttcctcaaggatctagaaccagaaataccatgtgagcaatcccattactaggtatatacccaaaggaatataaatcattctactataaagacacatggacacatatgttgaatgcagcactatttacaatagcgaagacatggaaccaactcaaatgcccatcagtgacagactggataaagaaaatgtggtacatacacaccatggaatactatgcaaccaaaaaaggaatgagatcatgtcctttacagggacatggatgaaactggaagtcatcatcctcagcaaactaacataggaacagaggaccaaacaccacatgttctcacccataagtgagagttgaacaatgagaacacgtggacacagagaggggaacaacacacaccaggacttgttgcggggggtgggaggcaagggggaggggaagcattaggacaaatagctaatgcatatgtggcttaaaacctagatgatgtgttgataggtacagcaaactaccatggcacatgtatacttatgtaagaaactttcacattctgcacacatatcccagaacttgaaataaaacaaacaaacaaaaagaaagccatggtctctatctctgctggtctggcagaagacacagacattatataagcagatccaaaaagtgttacaggagccggctatgggggcactaacctggttcaggggcttaaggaaggttttctggaagaagcaacatttaatccaagatgtggaagaaaagtagaagatgatgatgttcataatggtaataagatgtaatgtttattaaaaagcttaccatgtaccaggtacttttctaaatatcttaattgactcatttaatctgcacataatgtaataaggtagatcctattaatatctctgttttagtaaaagagagctaaaatatagagaggtcaagcagtttacccaaagtcacatagtaagtggaggagcacctgggctttgaactgaagtctgtctcctcaatttcctctcttagccactatgctaaacggcattgataaattagagatgggcaggtgaggggtgttggaggacaggggactatttcaagcagtgagaacaccttgggtgaagaccttgaggaaactgagaccatttcaggaagtttttctaaaagaaggttgagagagctggggctgagaatcctgagaggagagaggcaatagataagactagagaaatgtaggcagggggccagatcccacaggcccttgagtctacagtaagagtttgtttatcctaaggacagtgggaagtcgttgaaagattttaagcagtagagtgtcatgatcaagtttgtacttaggacagtttactctggcattttggagaatggatgtggaggtagcaactcaggaggttgggagaccagcaggagactggtgatggtaaaccaggcattgggtggtggtggcttggattaaggaaactgagacagggactgggagagggagtcagacaagaaagagataggaggtaaagttatgggcccttgtcataaacttatgattgtggggctgagggagacagcagagtccaaaaggactgtgaggggtctgagctctgggcactgacataaaacactaagagagatcaggctttgggaagaaaataatgaggttgatttctgacaggttctatgtggatatcaggcagtcttactgtagattcgcaccaagctgagcctaagtcctttggtctagccatcatttaagttgttctaaattagatgctatattttatagtctacagaaaagtgtggtgcctcagcaatgtaatagtttaggaaaaggaaaatgttattttttaataagttgagtgtattccatgtagcacattgtgctatagttgggtcaatccgtttgctattttctctttgggcagaaagtatagtggaaagaacgggtacaggattatcacaggacctgagttcatatctcatcttcccacctttggcacttattagtgtggaatctttgatcagctattctgtttttttccatctatcaaatgtgttcaaaaatccccactttgtctaagatattaagagtctttggaagcgtggtagaaagtacaaagcattatgcacatacaaggcactgggccttttcccctcttcacctttcaattagaaacctagaaatagaattgccgtatgagttgatcagcttgtgtgaggttcacattgcttcaagatttattttggggtctgttgcaactttgttgtgatcaacacctgagtctcttgatgtgattatctaatatatatcaattttagaacatacctaaaacagattttttaaagcaatttttgttaatgtaagcttgtttctaaattaaaagttaaactaatgtaaccactaattgtattttaaagagatgccttaagcttcaactttatttttaacatatacaaaaggtatgtatggttagttactacagtggattaaagatatagttaaattattgctagtgaagtatcatttcaactatggtataattggaagactttcatagcttgacataactgtttaaagtctcattattttattataagcattattataagagattattataagttcctgtcatttctcactcaataccccactgttcccatctcatgctaaaagatatttagagttctttttctttagcttaaggctttttattattctcttttttcattttttcctctggggaagtgagaaaggaatgttctcatttttatttaagctagattctgatgaattatgatgttaatgagataatagtaccttttagatatctgtagcaaaagtatcatctttgaaatgaggaaatattttccagaatatactttgaatcaatttttaaaaaatactaaggagtatatatccaaatcttctagtaattttagctccaaaatatgtatatttgaaaattgtgaattactttttgtttttttcaaattgtttgttaatgttactgcaaatggagacatttatttttctcttctcttgtgttcctattttagtttgggttctcccaaaatcagatgttgagacacattcaagttcagtttatttgaaaggtgatcccaagaaacaccagtagggaggagatagagaagggaattcagccaatttggccagaaatctaataatccgatcaaaaaatgggcagaagatttgaatagacatttctcaggacatacaaatgacaaacaggcatatgaaaaaggtgctcaacatcactgatcatcagagaaatgcaagtcaaaaccacagtgagatatcatcttacccagttatggcttatatctacaggacattatcaagcactgtggcccactggagctttagcccacacaataactctggagctagagcagaactcaagtttcagggttatcttatctgaggggctgggaagtttgggtatttatacaccagtggccttagtcactggatgaaggctgttgatggggaggagcctgagttccctaggacttctagtctaccgtgtacttggcattgctggcttcagccaccagaaaaagtcctaatttatttatttatatatatttttttaatttgtaatttttgtgggtacacagtaggtatatatatttttggggtacatgagatattttgatacaggcatgcaatgagaaataatcacatcatgaagaatgaggtgttcatcccctcaaccttttatcttttgaattacaaacaaaaatgtacaattaagttattattgactacagtcgccacattgtgctgctatcaaatggtaggtcttaatcattctattttttttttaacccattaaccatccgcacctccctcccagccccccactacccttcctagcttctagtaaccatccttctactgtctgtccatgagttcaattgttttgagttttagagcccataagtaagagaacacacaatgtttgtcttctatgcctgacttatttcacttgatacatgatctccagttccatccatgttgttgtaaatgactggaactcattcttttttatggctgaatagaactccattgtgtatatgtaccacattttctttatccattcatctgtcgacggacacttaggttgcttccaaatcttagctattgtaaacagtgctgcagcaaacataagagtgcagatatctcttagatatattgatttcctttattttgagtatatacccagcagtgggattgctggatcaaatggtagctcaatttttagttttctgagaaagctccaaactgttctccatagtggttgtactaatttacattcccaccaacggtgtacaggggttcctttttctccacatctttgccagcatttgttattgcctgtcttttgggatatatgccattttaactgggatgagataatatctcattgtagttttgatttgcatttctctgatgatcagtgatgttgagcaccttttcatatgcctgtttgacatttgtatgtcttcttttgagaaatgtctatacacatattctgcccattttttgatcagattattagattttttcctgtagagttgtttaggctccttatatattctggttattaatcccttatcagatgggtagtttgcagatattttcttccattctgtgggttgtctcttcactttgattgtatcctttgctgtgcagaagctttttaagttgatgtgatcccatttgtccatttttgctttagttgcctgtgcttgtagggtattgctcaagaactttttgcccagactaatgtccttgagattttctctaatgttttcttgtggtagtttcatagtttgaggtcttagacttaagtctttaatacattttgatttgatttttgtatatggcaagagatagggggtctagtttcatttttctacatataactatccagttttcctagcaccatttattcaagagactgtcttcagtatattcttggcacctttgttgaaaatgagttcactgtaggtgtgcagatttgtttctggattctctattgtgttgcattggtcagtgtgtctgcttttatgcccataccatgctgttttagttattatacctctgtagtataatttgatgtcaggtaatgtgattcttccagttttgtcctttttgcttaggatagctttgacttttctgggtcttttgtggttctgtataaattttaggattgttttttctatttctgtgtagaacattattggtattttgatagggattacattgaatttgtagattgctttgggtagtatggacattttaacaatatcaattcttccaatccatgaacatggaatatcttccaattttttggtgtcctctttaatttctttcatcagtgttttatagtttttattatagagatcttttacttctttggttaattcctaggcatttaatttcatgggtagctattataaaggggattactttttaatttctttttcacattgttcactgttggcatatagaaatgctacttattttcgtattttgattttgtgtctgcaactttactgaatttgtctatcagttctaatattaatagttttctcatggagtcctttgctttttccaaatataagattacatcatctccaaacaaggataatttgacttcttcctttccaatttggatgcccattatatctttctctaatccaactgctgtagctaggacttccagtactatgttgaataacagtggtgaaagtcagcatctttgtcatgttccagatcttagaggaaaggttttcagtttttccccgttctgtatgatgctggctgaggggctgttgaggtatgttcctgctatacccagttttttgaaggtttttgtcatgaagggatatttaattttatcaaatgctttttcagcattaattcatttaattcattaaatgaatatgtggtttttatcctttattctgttgatatgatgtatcgcattcattgatttgtgtatgttgaaccatccttgcatcctagggataaatcccacttggtcacggtggatgatctttctaatgcaagcttgtccaatctgcggccaatgggccacatgtggcccaggatggctttgaattgtggcccaacacaaatttctgaactttctaaaacatgagattttttttgcaattttttttcttttttttaagctcatcagctattgttaatgttagtgtattttatgtgtggcccaaggtaattctctttccagtttggcccagggaagccaaaagactggacacctctgttctaatgtatcattgaattctgtctgctagtgttttgtagagaatttttgcatcagtattcatcagagatattggcctgtagttttcctttttttgttgttgttgttttttttgtttgatgtacctctgtctagttttggtatcaaagtaatactggcctcatagaaagtgtttggaagtattccctcctcctctagttttcagaatagtttgagaaggattggtactaggtcatttttaaatatttctaatagtagaatgagaattaaacttctttttttttgagacggagtctcgctctgtcacccaggctggagtgcagtggcgggatcttggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcccgacctcgtgatccgcccgcctcggcctcccaaagtgctgggattacaggtgtgagccaccgcgcccggccaaacttctttaaatattctaatagtagaattcagtagtgaacccatccaatcctgggcttttctttagtgggagactttttattacagcttctgtgtcatttcttgttattggtctgtttaggttttggatttttttctggttctatcttggtaggttgtatgtgtctaggaatttgtccatttcttctagatcttccaatttattggcatatagttactcatagtagccacttatgattcttagaatttctgcagtatcatttgtaatgtttcctttatcattttttatttgtatctttcttttttttcttaattagtctggctaaaggtttattagttttaactttaaaaaaagaacaactttttgtttcattgatcttttgtattttttttccatttccatttcatttatttctgctctgatccttattttttattttcttctgctaattttgggtttggtttgctcttgcttttctagttctttaagatgcattgttagatagtttatttgaagtttttcctcatttttgatgttggcacaaagtccttgggcaaagagatgcatttggaacgtgctccccagtggtatggtcagaggagatatgggcaaggcaccactagcttagctgtaattcccatcacaatatttgcattagatttcattttctttaagcaaagcaacaaagtaagcctgacgaaaaggtagaaaaggacttaattccaggagataattttaaaaatatagtagattagaggcataagttgatgtagttgatgtatactttctttgtgagtaaagtttctgcaacctctcagggtagttgatggattagcctgttttaggtattttcagtaaataaaaatgactgctgactaaatactgaacgaaccttgtaggtttgtgtttgtgataaagtatgaattaatctcttgtttatagtttaattctcatctactgaatgggagatgatttccacatggtctcctcagtacagggtgactgcaacacttggggaagatgtggcagatacagttggttgcttgttgacagaatcccacatttgtataggtactgtgtaatcatatgcttcaggaaaagttgaccaatcttgattagcttaagcttattttgatttctttcctcttgctagtggttggtttaggagcatgcatatcgcagttctggacaatgagatatgagaggagatttgctggagggagagattctgagaaggctttccgagccttaagaagaggtagaagaaagggtgttattatgtgaggatgggatggatacctgtggccaccttgaagaccagacagaataaactggggaaagaaccaacacactgaggatcacagagaagaaagatggaaagcttctgggatcttgatgctatccctgacccactcagtttgcccactctggaagtacctgaatgtttcctgttactttgagataaaaattccattttttaaggatatttctgtcagtttcagctgaaagcgtcctaagctacagattcagtagaaaaggagggaaattttcttgtttcaaatgaaattttataattgatttaaataaagtccaatgggttttgggtgaacttaatttattgctattcatttgaatacagacatggatgaaaggaaaagacttttgtatgggatatggttgcaagtcttactgaataaataaagtctcattcctgattatgctggttattgagttcttgtccatatcaggtagttaaattattttagtgcccaggtttatactttataaaaccaaagagtagaggtatgtgggaattgtcttattaccattattctttgagaactattaacaaatgattcaggaatattggattttcaattaacttgaagtaagtttcttgggatgatctgcttttagttactctaaatatttttagcaagtacctggtaatctgggagactgtggcccaaagtagttcaactgaatttgaaaaggatcaggactggctatgaagtgaggctgagtgggtacatctatatgtggatacgttactgtcctttgtgcatatttctttctaattacgttccaaatccaataagaagtcaattgtattcatcatcctgggggtatcatcttaactctgccatttttccatattaatgtattaagtataaaggttgtgaaatccatttcagatgctcctggtttgggaagtataaggttacagattcaatggcatttaaatttctttttttcctctctcctctttttttttttttttttttttttttgagatagggtcttgctctgtcacccaggctggaatgcagtgacatgctcactgcagtcttcacctccccggctcaaataatccttcccacctcagcctctctagtagctggaactgcaggtgtatgccatctttcccggttaatttttgtattttttgtagagacagggtttcactatattgcctaggctggtagatttctttatttttaaaatagaaatggtggggaaatgtaccatccgggtcactgaaaagctggagcaaagatgtatggaactcagggacatggactctactttgcatccctggtggggtgggggtgtgtccttactgatgtagactttaagaaccatgagagcctgatgtgtgtgtataaatatggctttaaaaaagaagacagagattgtttatctttaatagcagtaatataaggccgaagtctaaaaggactctaggataataagaaatgaatcctcaggctggcatgatggctcatgcctctaatctcagcactttgggaggccgaggtgggcagatcacttgaggtcaggagttcgagaccagcctggccaagatagtgaaaccccgtctctattaaaaatacaaaaattagccgtcatgaggatgcatgcttttaatcccagctactttggaggctgaggtagaagcattgcttgaacctggaaggtggaggctgcagtgagccaagatcacatcactgcactctagcctgggcaacagagtgagactctgtatcaaaacagaaaaaagacctcagtctgtgaagactttggtcatacactattgcttggggtttaagggaagctgcctttttggttgggggtatcctttctgataaaagagattcagtaacttagtcaagctttgctctgtgaatgaaggggtgtgtgtgtgtgtgtgtgtgtgtgtgtgtgttgtggggggtgggtgtgcattcttttcctgccttctggttttataggagaaatactcattgggtcttggaaagacgacacttcctgtgtttaaggtacagtattatgctgactagtaaaataatcttaattctttgataatgggccaaaggcaagtacaagatgaataggaaagctattattacaggttttaattttgaaaattttatgcctctttttctattttttgttatatttttatattactgtcatttctgccccttatttggtactgatgcctcatatcagggatatgacatataccatagatatatcatcaagagtaagatataacatcagagaagttatatcgtctattcttaggttctctccacaccccatagttattcttttatttaactgattcaataaattaattgatcaccactggtatgtcagacgctttgcaatgcctaggggtgtagcagtgaacaaaatgggcaaagtctttgctctcatggagcctgcattttaatgaggaaagatggacaataagcagacatttggtaagtttggtggtgaaacgtactaagaagaaaaataaagtagatgatagaataatagaggaggatagagaggaagtttgtatccctgcttctttgcataggatgatggttagggaagattttctcgatacgttgacatttagactgagacctgaatggaatttctttactccactccaaccatactggcctctttgccattccttgtgtatttacagcacaaactttgtactaatttatccctttgcctagaatactcttctgagagatagtcacaatttaaataagtagggaaaaggattgggagttatcagttgtgttaccaggcaaatggaattccctcttctattagaagtgcagaggatgggtctggcagccattgaattgtgtagaattatggtttctttagtgaatcacttctaaaataacatgcataatttgtttaaatatacatgatgtttaggataatttttttgaagacttaattaatctcacctgttatttttcccgcacttgttactttacaaaaattaaagtggactatctaacaaaaaactaagttgtcttggtcagtttgggctgctgtgacagaatactatagactagatggctgaaacaaaacaaatttattgctaaaaattctggaggctgggaagtccaagatcaaagcttctgatgtcaggtgagggatttttcctggtttgcagatggctgtctttcattgtatcttcacatgcttgtgtctttttttgtaagggcattaatcccattaataattacctcccaaaggccccacccgcagataccatcacattggagatttaagcttcaacgtatgaatttggggggatgcaaacattcagtcccagagcataagttataatattttgtcagttgacctaataaaacatgatatcctgggtaacagcatagaggtaatcacattacttttaacacaaataaaagcttggaaagctttttggtaagctgaagaggaataacagttttattctaatgcaatttttaaaacaacaataggctattgttttacacatctctctgaaaactatacatttattgactttatctagaagggcagtaactatgtatctctttattaatctttctcctaaacatactgaaaatattttgcagtacacccttaggacttattaggtttataaagaaaaggcagctgtgaatgaaatgctgaattgcatcccccattggatcaactctaaaataattatgcaaaaaataagaataaccccatttttgctgaacatataaattttatcattgcaaaagaactgaatagttcaacaccacattctcatggagatgtcttactgggaccgcagtagttgggtgtactattgttgaaaaagataatttctatttgtatgtaggttactctgtgcctaaaatggatcatttctaccatcgtattttatcttccttgttttccacctcatcttttatttatacttcatagatcatgatatttggagcatatttggctattagccaattagtgcttatcttttataatggttttcaaggataacagagataaattaaattccaaaatattactgaaacatcattcccaatagcaactataaccttcttctcgcccgtgctttttctggaactatagaacagaccaaatgagatttcaccttttttttgtttttaagctaactgtgccctccagtggagaaaacacagggcagtgaaatagctcaggtaagaagcagcagagaggagaggatgtaacacagccaggtaaagttcaagctgcgtagctgttttctacataaaagaaagaaattgttttcacccctcataagcaagacttttttttttcttttttttgagacagagccttgccctgtcgcccaggctggagtgcagtggcatgatcttggctcactgcaacctctgcctcccaggttcaagtgattctcctgcctcagcctcccgagtagcggggattacaggcgcgcaccaccacacctggctaagttttgtaattttagtagagacagggttttgccatgttggccaggctggttgcaaactcctgacctcaggtgatccgcctgccttggcctcccaaagtgttgggattacaggcgtgagccactgcacctggcccataagcaagactattatgcataagtcctcctcttgatgaatttgttgatgaatcaaagaaggatatattatcatttctctgacttaatgtctttgatgcaatgcttttcagccttttgtcctctctggtaggatgtattcagtttttgacacattaggcaagtgtaacaggaggtgagtaattggatttttttctcccctagaatgaactcaaatgataacttttaattttttaaattttttgaacagatgaaagaaaaccttaaattaagtagatataaacaagaaacattttgctgctacttgtatattcaaatcattcagaaaactatgaattgactatgactcccccttttttgaatagaaaagggagagagttgacctgacctctgtggcttggcctgaacttgatctcttggtgaacactgggcttcatcagtgtgaatggtgactatgtgtgactgagcacctgtgagggttacagaggcacgtgttcagaacatgggctggtatgtgtgcaactctgggctggggaatggagccaggtttaggggatgctagactgcctgtgtttctgcccttccagggagggagaactaggtaactaagttgaagctgaaatgttaaaggaggcttgatggttttgtgttggtggaaattgggagatacgtttccctaaaagaatatagtgggtgatagttgagaaacagtaaacagaggctttctttttcttaactcttataaaaccctgagccaactatccttacaatgagttgtcatttgaagttttctacatactcaagaaatatgtttccttatcttattttaatggagcgtatcttctgcaaacctttttacagttagagtgattcttaaaatttaggcacatacaggacaattagacataaaaagacttgacttacagattttaaagcagggatccttgcatggtagactttcaaaatgatagtatcttttacttgaaccatcttttgcaaagtaacataaatatctcagagacactgccagagcgaactcacttttagaaaaagcaggatatgtaaacttttagtgataaattttgaaattcttgaggggaaatgatatgtgatttaagttccttcaaaataatttatctttattttatttttattttaaataatgaattatgttttaagatctgattcattctgaactataactgactctagagggtgcttaatgagcactgaagacttcctaaagatttatattgaagatgatttttattaaaatgaagtttatttggggttttaatccagtatttgaaaataaaccatattttgccctcccaagagagcctagagcaaaaatacttagttgtcagtattttttcgtttttttgagatggagtcttgctctgttgcccagactggagtacagtggcacgatctcagctcactgcaacctccacctcctgggttcaagtgattctcctgcctcagccttccgaacaggtgggacaacaggtgcatgcgccaccacgcctggctaatttttgtatttttagtagagatagggtttcactatgttggccaggctggtctcgaactcctgacctcaagtgatccacccaccttagcttcccaaagtgctgggattacaggcatgagccaccgtacctggcctagctgtcattctttttaaagtaggtaaataatttaccattgttcttagaaactctttgaaaattccattgaatttgtgggatttctataaactacctttgaatcatgcttttgaaagcttgtttaatatttcaaaagaaaagaacctacttcatgcatataaaatataaatcttagtactggattagtgtatcattttataaatttagttgtttgcacagatatttattttatctttagaaagaagctattcaaaaagcacattctaaagttagattttacagaacatttaggttttagagtaatgtatgcttcttatatttttagcaggtagagtacttttaaaactatggtgtgtttttttgtttgcttggttggttggttttttttttttttttttgagacagggtcttgctctgttgccgaggctagagtgcagtggtacaatcacggcttactgtagcatcagcctcccgggcttaagtgatcctcccacctcagcctcccaagtagctgcagctacacatgtgtactaccacacctgactaatttttatattttgagtagagacgggtttttgccttgttgcccaggttggtctcaaactcctgggcccaattgatttgtacaccttggcctcccaaagtgctaggattacaggcatgagccaccacacccggcctacagtgtgatgtattaatttgaagaaaattttcagacttttcagatgggaaagcttttagaaaattgctgtcttaacccaaacttcaaagatggtgatgataaagatatacattgtaaagcaaaaataaaatttgaagggccccccagccccctgcagccatctgaatggactccctcatcagcaagggcactgtaaaatttaacctgaaagactgactcaggccatgaagtaggggttggacatgcctcattatacccctccagcattaacatcaacacagaccttaagtctgataagaaacatttacaatctattttctctgaagcctgctacttggaggctttgtctgtataataaaaccttggtctcagcctggcgcagtggctcatgcctctaatcccaggactttgggaggcggaggcgggcagatcacgaggtcaggagatcaagaccatcctggccaacatggtgaaaccccgtctctactaaaaatacaaaaattagctgggcatggtggcatgtgcctgtagtcccagctactcaggaggctgaggcaggagaattgcttgaaccagggaggcggaggttgtagtgagctgagatgttgccactgcactccagcctggcgacagagtgagactctgtctcaaaaaatgaagaaacaaccaaaaagcttggtctccacaaccccttatcttaacccagagatttttttttctactgataataactctttcaaccaattgccaatcagaatatgtttaaatctacctatgacctagaagcccctcccctgcactgagttttcctgcccttccagatctaaccaatgtaaatcttacgtgtattgattggtgtatatatcttccctaagatgtataaaagcaagctgtaccccaactatcttggggtacagcttctgaggctgtgtcatgggtgcgtccttaacgttggcaaaattaactttctaaactgactgagacctctctcagattttgagttcacaacgtttacaaaaggtctgtgttatagtgagaaaactttgctaaacaaaatgagttatccttcattggagtattagtcattgcagagaatgaatgttaatgtaaacttttacatgatgtcagcctatgaaaaagtgatgtgtttccatactacccgtttgtttaacatttcttcagaaatatcacactgttttcattactgcaggcagagaatcatattagaaaaattcagtaatttgatgtgaaacctatgttttactcattgaaggcactgttatccaacagaactttttatgataatggaaatattctgtatctacactgtacaatttggtagtcaccagcttttttaaatttttttgttatactttaagttctagggtacatgtgcacaacgtgcaggtttgttgcatatgtatacatgtgccacgttggtgtgctacacccatgaactcgttatttacattaggtatatctcctaatgctatccctccccctccccccaccctacaacaggccccagtgtgtgatgttccccttcctgtgtccaagtgttctcattgttcaattcccacctatgagtgagaacatgtggtgtttggttttttgtctttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgctgcagtaaacatacgtgtgcatgtgtctttatagcagcatgatttgtaatcctttgggtatatccagttatgggatagctgggtcaaatggtatttctagttctagatccctgaggaatcgccacactgtcttccacaatggttgaactagtttaccgtcccaccaacagtgtaaaagtgttcctatttctccacatcctctccagcacctgttgtttcctgactttttaatgattgccattctaactggtatgagatggtatctcattgtggttttgatttgcatttctctgatggcttgtgatgatgagcattttttcatgtgcctgttggctgcataaatgtcttcttttgagaagtgtctgttcatatccttcacccacttgttgatggggttgcttttttcttttatatttgttagagttctttgtagattctggacattagccctttgtcagatgagcagattgcaaaagttttctcccattctgtaggttgcctgttcactctgatggtagtttcttttgctgtgcagaagctctttggtttaattagatcccatttgtcaattttggcttttgttgccattgctttttgtgttttagacatgaagtccttgcccatgcctatgtcctgaatggtattgcctaggttttcttctagggtttttatagttttaggtctaacatttaagtctttaatccatcttgaattaatttttgtataagatgtaaggaagggatccagtttcagctttctccatatggctagccagttttcccagcaccatttattaaataggaaatcctttccccatttcttgattttgtcaggtttgtcaaagatcagatagttgtagatgtgtggtattatttctgagggttctgttctgttccattggtctgtatctctgttttggtaccagtatcatgctgttttggttactgtagccttgtagtatagtttgaagtcaggtagcatgatgcctccagctttgttcttttggcttaggattgacttggtgatgcgggctcttttttggttccatatgaactttaaagtagttgtttccaattctgtgaagaaagtcattggtagcttgatggggatggcattgaatctatacattaccttgggcagaatggccattttcatgatattgattcttcctatctatgagcatggaacgttcttccatttgtttgtatcctcttttatttcgttgagcagtggtttgtagttctccttgaagaggtccttcacatcccttgtaagttggattcctaggtattttattctctttgaagcaattgtgaaggggagttcactcatggtttggctctctatttgtctgttattggtgtataagaatgcttgtgatttttgcacattgattttgtatcctgagactttgctgaatttgcttatcagcttaaggagattttgggctgagacgatggggttttctagatacacaatcatgtcatctgcagacagggacaatttgacttcctcttttcctaattgaatactctttatttctttctcctgcttgattgccctcgccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagggctgttgaattttgtcaaatgccttttctgcatctattgagataatcatgtggtttttgtctttggttctgtttatatgctggattacgtttattgatttgggtatgtcgaaccagccttgcatcccagggatgaagcccacttgatcatggtagataagctttttgatgtgctgctggatttggtttgccagtattttattgaggatttttgcatcaatgttcatctgagatattggtctaaaattctctttttttgttgtgtctctgccaggctttggtatcaggatgatgctggcctcataaaatgagttagggaggatttcctctttttctattgattggaatagtttcagaaggaatggtaccagcttctccttgtacctctcgtagaatttggctgtgaatctgtctagtcaccagctattgagagcttggaatgtggccagtgtgactgacgaactgaatttttaattttgtttcattttaattaaaaattaaattaatagcaatgtgtatctagtggctaccctgttggactgcactgattttaagtcctcctgctaggtgataggtgtatctgggattgaattatgactctgatggtgcatatgtgtatctgtttagtcctttgaacttttataatcctgcctgaggtactataacatgcaagcaccttgttttcaaatagccacatttatgtgaaaagaagaggaattgtgttctgaaaactaagttaagtttaggttaaacctgaaacttaacttaatttaaaaaatcctctgactttttaacaaacccgtagattaaattgcatttgccctttggatgtgtctcaaaccctgaaggttttcttctgtgcttttgagttaaaatgcaggtagcatataacaggtgactgcaaaatggagggactgatgaaaacaaaacaaaagcaaccacaaaccagaacttatatctactctgtaggaattttgtttgaaagttggtatgcttttctgaatgtccttaagtataacaagtcttcctactctgagggtaaacttgggtattataaagaggcaatttgtgcttacgtctggtaaataatgataaaatacttgagtaatactttataatttgccaggcagttgcgatttcatcttctccttggaatattaaccccattctaccgacaagagaaccatgatttaatcaaggttctcattcatttcgcaaacccttattgatcacttactattgatcaccttgctattcatgtagatttctatgttaggaatgaaagaatagttcctctcctggaggaattaacaatctagttgggacaattaaacaaagaaacaataaattatactgtactcaacaggatgagattatatattgtattatatattatatatattatacatatatatatatataaaatatatatgtgcataggatgcagtggaagaagaaggagaaacatctggcatggtggtgagacctgagggagtcaggagtttcccaggtgaaggaggcaggggaaaggtgccccagaagaggatatgtcaggagtaaaggtgtgaaggtgctagtgttctaaatcagaataaatttagtaaatagaaggtacctgaatattcacatgcacaaaatttactagcagtcttatatcattttgaccttgctttttttctagctcagtctgaagaaaagctgggctaaaaatagctcctggtacagtgataaagcatccaagtaacgatttcaaggagaaagttaagactagatttagttatttggcaaacactaacttacaatattgatgtgctaataagaaatcatcttacttattaaagcagatccttagaggcctgtttttgttcctcttactggaatatcaattccatgaggactttaattcactgttttctcagggcctagaacagtacctgacatatattagaagctcagtaaatatttggtatataaaggaatgaatcctaggctattatgctaaaagtcactgtgaatgcttaaaccatattagaaatgtgttttttaaaaattcaagaattcattcatttccattattcagactagccttttctccagtgtctgagatacctattgctatataacaaactatcctaaaacttagtgattaaaaaaaattattgcttatgattttgtggatccggagtttgggcagggcttattggagacaacttttttctattccacatggtattggctgggggtagagggttcacgatggcctcacctccatgtctggggccttgatactagttgttaccaaggaagcctcagttttcttccatgtggtctctcattatttactagactaggttgagcttccttacatggtactgagattgttccaaggtgaaaacagaagttgtaagatatcttaaggccttgatctgaaagttatacactgtcagttatgccacattcttcttcttcttttttttttttttttttgagacagagtctggctctgtcgcccaggctggagtgcagtggcaccatcttggctcattgcaacctccacatcctgggtttaagcaattctcatacctcagcctcccaagaagctgggattacaggcatgtgccaccatacccagctcatttttatatttttagtagagatggaatttcgccatgttgctcaggctggtctcaaactcctggcctcaagcaatccacccgccttggcctcccgaagtgttgggattacaggcatgagccactgcacctggccagttctaccaaattatgttggtcaaagcaagccacaggaccagctcagatttaagtggaagggaaaagattctactttttgattggagaatgtcaagttcctatagcgaagtggcatgagatggaaggtattgttgcagctgtctttggaaatagtgtgctacagtctgccctctgaacatatcaattcacatttcttccacgtgcagaatatacttactcctctcttagaagtcttatcccattatggcatcaacctggagtccagtatcttttcatccaactaaagtccagatgcatatgagatttcttaggcacagctgctccagtacagcttctttagatctagaaatctgtgaatgaaaatataagttacctgcctctgtctcccatcccccatccaacatacagtggtgagacaggggcaagaaaactgtagtagatgctctcatttaaaaagaggaagaattggaagcactgttccatagcaattttgaaattcatctgggcacatgttactaagtctcttaccccatgtatcaaaaatataccttgaatagccttttcacaagatggcgctgaaagcaaagaaggaagctcctgcccctcctaaagctgaagccaaagcaaaggctttaaaggccaagaaggcagtgttgaaaggtgttcacagccacaaaaaaaagaagacccgcacgtcacccgccttctggtggcccaagacaccacgactccggaagcagcccaaatatcctcggaaaagcaccctcaggagaaacaagcttgaccactatgctgtcatcaagtttccattgaccactgagtctgccatgaagaagatagaagacaacaacacacttgtgttcattgtggatgttaaagccaacaagcaccagatcaaaaaggctgtgaagaagctctatgacattgatgtggccaaggtcaacaccctgattcagcctgatggagagaagaaagcatatgttcaactggctcctgattacaatgctttggatgttgccaacaaaattgggatcatctaaacttagtccagatggctaattctaaatatatgtatatcttttcaccatatacatgcctctgtcaatttctggttgggctgggaggccatatacaggcattgacattgtaacagggcttggtcaagactcttgttttacttatgcttttggaatactcaccctgccactccaccatgtttgatcactccagagatctatgtgactagagttagcatcataggaaaaccagaactcagaacttgcctccatggttgagggtaacaagaagctttagaagaaccccttttatccctggaagaggctgtgtgtgaaaccaatgcccagagtttgaagggtattagcatccatttcaggcgagtatgggttggctggctttcaggtagcattttgtcctcatacacccatctactatggtccaactggtctgtctgtttccctcactccttgtgcaataaaggacaaggacttcaaaaaaaaaaaaatatatatatatatataccttgaatagtgcccagttctgctctttgagagttgttccctagtacattgttttgtaagactattagctctaccctttgggctcttggctttctccttcttttttctttttcataagaaataggtcatatttgtagctgagtagcttttcaacctgcttcttacctatgtgaagttgggaacccacagatattttatttctcccattttgaactgtttctttctcttttagtccaaactggtggtacttttagtacgatagttttctttaaaactttgagagttttctatgaatgttattagggattgattctatgtcccaaaagccacatttataatccctttccaggacagaactgtctttactttgggtctgcctattgaagaaaaggtcattaagattcttcgaagtccctttgtatagatgagaagggtctatattttcaaggtctcaacaaaagatcttatggacaaacctctgatttgatatctccccagagaccatttttaaatttcagatctttcgccagttgtagagactgttttgggccctctttacttcctctaaattctgcttaaaaattaaacaggtccttctttagtttatttctctcttctccatactttatcatatgcagctgaaagaagccagttggtactactttcagtgttctacctggaaatatctttagccagtcaataagttaattaggtaaatattctatcttatgtaattgttaaattaggtaaatattattgcagacaacagtcttgccaaacattccaccactgtgtaacatgaggcactctctctcctgcatctaatagcaattttctcatggttcttctggcctttgctaacaactgactttccactttttcagcctctgcctgccatcaggtcccaaaaccaatgctgcatattttaggctgtttggcacttcccttaagcaagtcaatcaaagcaagtcgcatatccaaggaagggaaaatagattccatctcttgatgggaggaatggcaaattcacattgcaaaagagcatgtggaatgggatgacttatagtcatctatagaataatctattgcacctagtaagtttaaacttggaagatttactataggtgagaagttaacaagtggtagcctgtgtatgtatctggctcacagatatggtatatttggcttggatagagttttaatgaaaaaaaaccaacataatttatcatcaaacaattgggagattttatctagaaggttatatatcaggtctctcttgaaaaatagtaagctgtttttgtgttgggccttcatttccatattagctggaaattgcctgatttactccctttcatgacctcttggctcctataggtatttgattttgcagtttttgctgctgcagattactaatttatatgttagttttttttaagggaatatggtgatgagcaagacagtcatagagcttacattcaagtatgggaagatggacaataatactagataaataatgtaattgcacatggaagtggaataaagcaagaatctgggatagaaagtaactagtaaataggtagttggggtggggatattttagatagggtggtcaggaagccctctctgaagacatgacgttgagtggccttagtgtgagaaggagccaaacatggggtaagagtgttccaggcaggctgagcctcgtggctgatgcctgtaatctcagcacgtttggaggctgaggtgggcagatcaccaggtcaggagatcgagaccatcctggctaacatggtgaaaccccatctctactaaaaatacaaaaacattggctgggcatggtggcacgtgcctgtagtcccagctactcgggaggctaagccaggagaatcgcttgaacctgggaggcagaggttgcagtgagctaagatcgcaccactgcactccagcctgggtgacagagcgagactccatctcaaaaaagaaaaagaatgttccaggcagaggaaaaagcaagtgaaatgacccatgggtgggcctgggcttggggtgtttgaggaaaggcaaagccgagagtataagaggagaaaatggtagtagaagaggggcatgaacgaggtcatgaaatatcctgtaggacataaaaaaacttgagctcttattctgagtaatgggaagtcattgaaggaattgaacagggctaaggttgtgatgtcatttactttttgcaaagatgtctgtagctgctgtgtggtaaatagactagtggcaaagggtggaagtaggatgttgtaaaggaggcttgcagtcatctaggggaggtataaatgatggggccttgaaccagggcatggtacttttaggagtgagaagtggtcatacgtggtatgtattagacaggtcttatggattattgaatatgggatatgggaatgggaggaattaaagccaactttgaggcttttggcttgagcaactgaataaatgggtggtcccatggggagttctgacagaggagcaagctcgaagtgggaattgagagttttctcttgactattattaactttgtgaccctactgcaaaaataagtttgaaaatgaaaactcctaaagtgaaattgtttttatcttacagctctttatatgtgtttttttcttcttttcctcttcattagaagactttgccattacttggatggcataccagctgcaatggaggaagtatacagatgtatattggaggatgtatttatattttaatgtgtagctatctgctgtcaagaattaggcaaggagactagtcactcacacctgtaatcccagcacattgggaggctgaagcggaaggattgctttaggccagggattcgagaccagcctggccaacatagtgagctcttgtctctacaaaaaatttaagaattggccaggtgtggtggctcacacctgtaatcccagcactttgggaggccgagatgggtggatcacttgaggccaggagttagagaccagcctggccaacatggtgaaaccccatctctactaaaaatacaaaagtactagctgggaatggtgtcaggtgcctgtaatcccagctacttgggaggctgaggcaggagaattgcttgaacccgggaggcagaggttgcagtgagccgagaccacaccattgcactccagcctgggcaacaagaaaaaaaaaattaagaattcgcctgccatggtggtgtgctattttgagtaatgggaagtcactgaaggaattgaacaggggtagtgatgtgatgtcatttactttttgcaaagatgcccctggttgctgtgccgtgaatagactagtggccacaggtggaagcagaatggtcatttaaaattttctatttattccaattcagtgtggtcataaaggatcaagtgtaatttattattcacattttattggtatggagaattaattcatttttactattaaaaaaaggtggcatgttagtaatcagaatgttctaggagaaccttccagaggtttgcaactcttagaattgaaatcactatttagctaagaccagaatcgtaacataaggcaagattgaataaggtgaatggatttgatgaattaaagtgctacttgtaaaggatagtaaattcacttttgcattttagatagtagcttttattgtaaatttggatgcaaaatgagataatagcgttttcaccccttttcaagagccatttggagatagcattttgactagatctgtcattcaattcagcttagaaataatttataattttatttttaaattcctattttaggatattatcatattatcatgagataatgataataccactctaattttattataattgggttgggaggaaatagtcttttgtaaaaggttagttagtggcatattgccattagcatttattttaccttttttagaaaatgaaaatcattacacttaaattcaatgtatattatatagagaacataactgatttataaccatgtaaaatatcttgtcttactaacaaaacgttcagtttttccttctttgtgaaaccttgagtcaaaatgtactagtgaggatgtttatattccagtggtgtagctgaaccagacaggtctgcagcgcagtggtttatttttagacctgcgttgccatttttatcctgcaaaaatattcatcagtgtcttgctgacaggccatcagtttcataaatgtgtcacatagaccagattttgttctttgtctcattttccctccaactcttcttttccttttgatttgttcatacaactgtttggaggaggagaatttttttttttaatttcaattcatgtattagatgcttcaattctaagatctaacagattttcagatcacccagttcattcatctatctgcatctgcttacacatctctacttattgtctgatatgagaagctgttatagatcactaagctgaaggcaaggaaaagagaattgcatgcattggggattctcttcatgggtccagtcagtttttgactgccttctccatatatgtttttatatatttatgtgtatgctctgtgtgtgtgtgtgtgtgtgtgtgtgtgtgtgtgtgtgtgttttcgtttatttacttgtcttacccaacaagggactggcataaaatattttgcataaaaaaaatagctgcctaagggcctaggggttaccatatgtggcagaaagccatgtattgaaaataaatccatcattatctttaaatacatagagcaccaattatttaatttgttaggagactgttttaacctgtttgggctgctaaaacaaaataccataaaccaagtggcttacgaacaacagaaatttatttctcacagttttgaagactgtgaagtccaagatcaaggtcctggaagatttggtatatggtgagggactgtttcctggttcacagatggtactttctcactgtgtcctctcatggcagagggggcaaatgagctctctcagacctccaaaagaggactgatcccattcatgagggctctgtcctcgtgatccaaccatccacaaatgccccctgctagtaccatcaccttgtgggttagggtttcgactatgaattttgggggaacacaaacattcagaccgtaacagagatgatgttttgattccagatgcctgagtgacaaatatcaccaaaacagaaggaaaaattcctgcaatcaagagaaactaggggcacatacttgagaatatagtaattttttaacagtgtatattcatgtctcatttttataaaaactcagattcccagagcaggattggtattcacttatctctgtaacaaatatttactgagtagctacttgagggcccaatatattaattgctttagtggctaccatggcttggagaacaggatttctgacttgtggagcttatagttattttaagaggaaaatacttctatgtatatttcacagacatggcagtacagcatactaggtaagagtataggcactggagccagaaatttgcatttatagtttgtgccagtcatttcctagttttgttaccttgagcaaactgttcagcttttctgagcctcagtttcttcatctctaaaattggtatgtacttcagaaattattgcaaaggttaaaaaagatgatgcttgtttagcaatgtgctaaaaatactgaacatcatgcctagcacatagtaagcacataataaatgctggttaattcataataacagtaataacaatgatggggataacaacaaatattctatgcatattctgtaatgctttaacatcaggaatgtcttcagctgtaagtaacagaatacacaactatggtggcttaaacagataaggatttattaatctaacaagtctgacataggccagattgaatattaattattcaacaatttttatcaataatctatatgccagctactattctaggcacaaggattcatccattaacaaaatgcagttattcctgtcctcatgaagcttacattctaattggggagagagacaaaaataaacaaaacaatgtaatataaaaatggtaagttattactatgttagaaggtgggcttcatagaaagctttgtgaaggagggcccatttatgttaggccataagggaacaacagagtttgaataaatgaggctaggtgagagaaagacacaacagaggaacagatatgagaaaaatggaggagccattttgagccatctcaaaatggaagttttggcaacagtgctttgttaatcatcaagtaatcaggagccatgaacgcaagatttttctcagatttctaaagtaaaagatttcatgttgttattttcactttatgtaacagttaacaatcaaataataatagtgatagtaatatgtagtgcttacaaatcaaacgttctacttaatactaatgataataaaagcatatggctgacacttacgtaatgctaattaggtatcacactagtctaaggatttggtattcatatcctaatctctgtgttaagtactaatagtattcccattttacagataagtaaagttaggtagtttggtaacttggcccaggtttatttgcccttagtgtctctaagggcgataagaaaagagataactggagagatagcctctcattccataatccaggggatagagtgggtgaggaaatgttcagggaatataagtaggtttaacccctaaagcccgagcaaaggaagaaaggagaaattgagggcgttagtagggcttgagatggctcatctaaacagttacccacaatttccacaactctggcagaaatttaccattagatgagattaggtccagagctttatcatatttcagagacaggctttccaatgctaagcatcacacatataccttacccagcagggaccattagaatccttttctcatagggagagtgtcttttgttgtttgtttcttcacttggttatctcttaaatgaaagaagaattttccaatttcaacatgagctttcaaatggaccaaattctcaagcatatttaggttgtgtctaaatagttcttatagaacaaatattatgatatgtgctgcctgttaaaatttctgtctgtattcatgtacacattctatgtctaattagaagctgccagccttgtcaaaatacaagtatggtccactgttaaaacctgatgtaagaaaatataaatgtataaaaatagttaaagttgggaggtggggggccatggagagtacttgcattctaaaaaaatttttaaggcttccattaattgggaaagtttgctttacataataattcaaagaatagattttatttatgtagtataaatgtgagaccacagttattacataaagggtgaacttacttaaatatactttatattaaggattcagtcatggtacaatgccatgctcattttcagtgaacaagacaactgtatactcagatagcatatggtagaaagaactgaggcatcacaggccaagaggccccctgaagctgaatgtggtcttgctggtgctgttagactgagtagcccttgtcggaagaaatggtagattccatcagaaaatgttcaatgtaaaatattacagcagtccttgtgattttcagtaggtgtttcccaagctactcttacgttattgggatcagctaactaaccgaaggtggctgtgttctatttaaataaaatcttgagtttagaaggtttcaggggagtcccagtttagagggaactttgtgtgaactttgattctgtttgaatcttgatcatgctagagaaataactcatgaatataaggcttttttttttttcgatagggagtcttgctatattgcccaggctggtcttgaattcctggtctcaactgattttcctgcctcagcctcctgagtagctgggattacaggcacacaccaccctacctggcttataaggcattttgttgatataaattcccatcatagtacaaaccaccatctcttaatgctgagttttacaactccttctccaagtatttggtgttatggtaaaacagtaggaaaaaaacacaacaattcaccctctttctaccctttaatccatttttgtttttaatcacaccttttttcctccactttgccagtgtgcttcttgatctcaggttgggagagatgaactatggcagtaatgtatagtgggcagtggactcccctttctccagagatggtagagtaggtttggtgcttttttgtttgtttcatttctggaaaacttgagtttatgtgtttttctgtctgaggctttaaatacaaactgaattaagcagacatctcaattgtggcagtaaccacatgggggcttgcatagtgtgattctgttttttttttgtttgttttttgtttttttgttttttgagaccgaatcttgctctgtcactcaggctggagtgcagtggcacaatctccactcactgcaacctccgcttcctgggttcaagtgattctcctgcctcaccctcccaagtagctgggattacaggtgcctgcaaccacgcccagctaatttttgtatttttagtagagatggggtttcaccatgttggccgggctggtcatgaactcctgacctcaggtgatctgcccaccttggcctcccaaagtgctgggattataggcataagccattgcacctggcccaattctgtttaactaatatacagaatataattttatttgaattttaaactataaaaacattacacaagaaatatatttacttatagaaaaattagaaaatccagctaagtaaaaaaaaaagaaaagaaaaattatttatattcctctacctagaggtaactaccatcaactttttggtctgtggctcttttagattctttagatttttttcccaaaacaaaaaatggctactgtacttgttactcctcccactgtatctgggaatcggattatttatgagctagattattggtaaacttcttttgactcatcattaggtgatgatccttagaaatttcaattaaagatcttctggagaaataaacattgttaaaacaaaaatagttaatttttgttaattaaaaaataatccattttttcttcacttggctgtgtatcatagacaggttttcactgccagtcaccattctttggtgccataatttttgataactgtattgtgttctattgtactgatatgctataatgtgtaatatagatatgctacatataatatagatataaataagggtataaaagattagtatgcaccataattatatactatatctatatgctattatgtgtgctatacatgctctataattacatattataatgtatttagtggccccttatggtttcaatgttggtattgtaaacagtgctgccacataccagcatcttaaaggtcttgttcattctgaaaaactaaaagggaaaggcaatagagtagcaacttagtaagggccagcaaatggcatagaaagttatgacatttaaagaattgtttcagatgtccttgcatcttagggatcaatgacaatttaagtaaaatgaggactattgtacatctaatagaatttaataaaataccaagtttatatgtttagtagtgtcctaatcttgtgaagggattgaaggtgttttcaaaatgttaaatagcagatagtattaatttttaaattaattaattgcaaagtaggtgagtaggtctgtaacagcacaactataacttcaggcatcagagaagttgttttttctctctttgagctctagtccagacagtaaacttcgttaagtaatttacatttgaaacttttgctggagaccaggaaatttctatggtatgtttgtagaataaaaagccatgtaagtaaataaatgaaatcactgaaaagtgcataagaggacgcttaaatcagacttgtattaaaagttctatttgtgagaggtagcttcttgaagggaggaaagtatgctttctttgattccatgaagctcacagtcatgctgtacctgctgcctatccgctgcatctgaaagggtagcttatctaagaagttgaatgaaacaaacttcaaatgataaacagaaagttatttcatcagtctttaacacttccacctaaaggttcacagaagaaataaaagtcatagagactagcctcaagttttcctcttttcttgttaaaggtctgtgggagagaaggtaaaaataatcaaaacatttttcttttaattcagttattcatgttctttctattttaaattgttgaagatgagctagctgtaggtttattgttttaaatcacagctctgacttgacatactgtttttaaaacttgtggatgtgtgtgtgttttttttttaataaagataagagaagtcattactttgattttatattcatcatagtcatggactcatagggtcttgggtgttcatttagtttgcaactacattgtaaagatgctgaaactaaggctcagaaatattaaccactggtccaggttgatttagctagcagaaccaggaccagaaaataggttttctgactattggtcaatccaccactattgtatgtagagtataatctctgtaactgagaaatattgtgctggattatatgaagcccctttaaaaagatttatctggaagtgaatttcactgagtgttcattttgaaaagtctgttagttgttaagttgtttaacataattttattggcagtctgggggtttaccaaaaagtagaaagaggatccagcaggatgttgtataacaagaaggaattgtgttgagcttccatggttttgacttctcagggatgagaaaaaaaaattagttgagaataaatgagcattcttcctttcttttctcacatttgttgttgatactaccattatttatttcagtcttcaagatatataaactgtttattaaactatcttttggtgaggctgttttgaagttcttgactaggcctgagtgagtcaggcatgacaagtagatttacttgatttctcctaggtgtaaagtacctaggggtgtgctgggcctcagcatcagtatgcttaaacacatgcctttaagatatatttaatccttaaagaaaaggtagttattcaccaggagactctggcccaaacataggactttattgtagtgttagtgtgataagcatggtggcttaaaaggagaatagctttctaaatctcatttctaaatctcttagtgaggtgagacagagtgaataaaatccagggtctctgtttttggagaatttgcccacttcttatatgaagaatattattaaatttttttttttcgagacagagtttcactctgtcacccaggctggagtacagtggcacgatcttggttcactgcaacctctgcctcccgggttcaagcgattctcctgcctcagcctcccaagtagctgagattacaggtgcacaccaccccgcccagctgatatttgtatttttagttgagacggggtttcaccatgttgaccaggctggtcttgaactcctgacctcaggtgatctgcccgcctcggcctcccaaagtgctgggattacaggcgtgagccactgcgcccagcctaaaatcttaaactggatgaattaggttgaaataagtcaaataatctacattagaccttcccttatgtttatctgggtggatataaatgtggaccactgaagataagttagctagtggaattataccaggtagatctcattacacctctttcacttttattagacctgagttatatacagtatttcaagggcacttgtgtagtagacaacgattgtcctactggtgtgtttgcatactgtttataactaaggagatgtttaatgtaatcatgttgactgaagaacaaaaagggtcataaatttcgaaaggagagctttatttctcataaagggttgcagcctgcaggttggtcatcctgacaagctgggaagcaaagcctcccaccagaatttggaaacagatacttccagggaggggcaaagggaacaggaatttatgctgggcagggtggccaaatatatatgttcagtaagctctaggaggcatcatgaatattcatggaaggagaaaatgtacacatgtgcaattgagcttcagacctttccatggcatggaacccgtgtccaaaaaatggcagcattagcatgatctcggggtggagttttcgatcttctgacatcaaaagatgaagcagagcacacaaaaacctttactgtgcttcctctgtagactggccagaaccactctatatggtttggctgtgtcccccctgacctaagtctcatcttgaattgtagttcccataatctccttaatgtggtaggagggacctggtgggaggtaattgaatcttggggtggttacctccatgctgttctcctgatagtgagttctcatgagatctgatggttttataaggggctctcctctgcccttagtctgtacttctccttgctgccaccatgtgaagaaggatgtgtttgcgtccctttctgccatgattgtaaatttcctgaggcctccccagccatgctgaactatgagtcaatgaaatctctttcctttataaattacccagtcttgggtatgtctttatcagcagcgtgagagtggactatacacactccatggttggtctcttatcaggaagaaatgctgctggttagttgttttgttgaaactgcaaaaggaaggggcagcagttaggctattggttgcagtcagcggtggatctttttttttttttagagacagggcctctgtcatccaggatgaagtgttgtggcccagtcataactcactgctgcctcttaactcttaggcccaaggaatcctccttcctcagcctctcgagtagctgggactacaggcaggtgccagcatgcttggctaaccttttttattttttgtagagacagggtcttgctgttgcccaggctggtctcgaactcctggtctcaagtgatccttctgcgttggcttctcaaagtgcttggaattatagatgtgagccactgtgcccagttgaagttcacgttattaattaactaattaattaattgacagtctctgttgcccaggctgaagtgcaatgacatgatcatggttcactgcaacctcagcctcctggctcaggcaatcgtcttgccttggcttctcaaagtgctggaattacagatgtgagccacaatgcctagcctcaggttgtttaaaaagtggctgatgggaatgaggaataaagaaaaatgtcattctcagtggtgaagagtgacttgggcacaatatgaaactgattccctggcatgttgtatttgggaaataccaggtggactgtttgaagttaaaacgttggttaaaggtaatgaaaaataaagttggattcagcattatcagattaatgaggaatccactctttggagtatttgtgtgtgcacagtgcattattgctgaatgcgtctgttataggtagttcctagtttataaagcaatattgtattgtatcgttgggtttatgttgtggcgatcagattatgatgtgatgagtgacaagtcatttaacctctctgagattgtcacttcttctgttaaattagatgctttaatcaggtcttattatctaccaccctcctagggttgtttggggaactactgattgtaccttatagagtgttgggatctgttaaaacagacattgtctgtaaagtatctgctactgtgtttggcacatgttaggcacttgatacatttagatttaaattttaaaaggctgttccacccataggagcagtccgaacttaggattctctgtattctgtagtgtaaattgagtgatacattgaatagttttacttcccaaattcaaggaatgatacaccaagaaaaatagcaatttctgtccctttcctgatctagcccttggtaaaaagctaatctttagtaacttttaaaaaaaggggtttagggggaattcatgtggaggtcagagtggaagaaggtgtgagagggcccagcagaagaaaacttggctgccaaagtgtttgagtccattggcaagtttggcctggtcttagccgttgcaggaggtgtggtaaactctgccttatataatgtggatgctgggcacagagctgcgatctttgaccaattccatggagtacaggacattgtagtaggggaagggactcactttctcatcccatgggtacagaaaccaattatctttgctgttctcgaccacgtaatgctccagtcatcactggtagcaaagatttatagattgtcaatatcacacggcggatcctcttccggcctatcgctagccaacttcctcatatcttcaccagcatcggagaggactatgatgagcgtgtgctgccgtccatcactaccaaatcaagtcagtggtggcacgctttgatgctggagaactaatcacccagagagagctggtctccaggcaggtgagcgacgaccttacggagcgagcagccacctttgggttcatcctggactacgtgtccttgacacatctgactttcaggaaggagttcacagaagccgtggaagccaaaaaggtggctcagcaggaagcagagagggccagatctgtggtggaaaaggctgagcagaggaaaaaggcggccatcatctctgctgagggtgactctaaggcagccgagctgatcaccaactcactggccaccgcaggggacagcctgatcgagctgtgtaagctggaagtcgtggaggacattgcataccagctctcgctctcggaatatcacctacctgccagcagggcagtccgtgcccctccagctgccccagtgagggcccaccctgcctgcatcttcacgggccaactggccacagccccgatgattcttaacaccgccttccttctgcccccaccccagaaatcactgtgaaatttcatgattggcttaaaaagtgaaggaaataaaggtaaaatcacttcagaaaccccatccccccaaaaaatgggggggcagggttaaaagaaattcaagtaaaattctcattacataaaattaaccattaacgaattcacagtgtacgattcagggggctttagtacattcacactgctgtgcaactttcacctctatctagtttcaaggtatttctaccaccccaaaaggaaacaccatacccactaagcagtccctctctatcctcccatccacagtccctggcaaccactaatctgctttcttcctctatggacttacctatttattctggatgtttcgtgtaaatagaatacattttgtgtctggcttctttcattaagcatgatgttcatatataaggttcatccacattgtagcatgtatcagtacttaatccctttttgtggctgaataatattccattgtatgtatatactacactttgtttattcagccatcatttgttggacatttgagttgtttctaccttttggctattggcagtggtgctgttaggaacattcatatacaagtttctgtttgaatacaggttttcagttttgggggctatatacctaggagtggaattgccaggtcatatggtatttctgttgatctttttgaggaactcccaacctgtttccttcagtggctgcaccattttatagttctactagcaatgtacaagggctttaatttccccacatcctcaccaacacttaatttacattttaaaaaattacggtcaacctagtgtgtcactgtagttttgattttcatttctctaataatgttgagcttttttcttatgcctgttggccatttgtatatcctctttggataaatgtctattcaagtcctttgcccaattttaaaattggatcatcattttgttactgagttgtacaaattctttatatattctagataataaacctttattatatagatgatttgcaaatgttttctctcattctatgtgtgggttgttgtattagtatgttttcacactgctgtaaagaactacctgagactctgtcatttataaagaaaagaggtttaattgactcacagttctgcatggctggggaggcctcaggaaacttacaatcatggtggaagatgaaggggaagcaaggcatgtcttacctggtggcaggagagagagatcgagggggaactgccacacgcttttaaaccatcagacctcctgataacccactcactgtcacgagaacagcatgagaattcctattttcatgaggccccttccgtgttactcccacattttgggtattcccaaaggaagccacaaagtagtttgaatcagatcacactgaggcataaagattgatagccttttaattcttatacatgggtttgcatttttaaagaggatgtggcattaaccaaaatgaatcattatttggaagggtttttagttaaccaaataaagtgaaaaaatcaggcagaaggcatttttgggttatggtgccaccagaaggaatcgcagggccttgcctggaagtcggcccaggggagtaactgcctttaagcaaatctgcttttcacagttttttttttgttttcgtttttctgttctggacctatagatgctttgaatttttgttattgttgttgtttgggtttgccagttttttaagtgacaagtagaacagtctgcagtgtctggttgggtcaaaagaaggggagtaaagagtcgaagagagggctgctcagtggggaacctgaaaggactgagtgggaaaaaggggactctgtattgggacaggacatttgtaaactgggcattttctttctataataatctactgttcttgaagaaagatgtgtgcttcctcataccatgggattgtggaaaatgcccacaatatctgggtgtatgcataaactaatatttttctgtaaaattatttttataatatgattaggagaacaagttagagtggtcttatattgcatcactttcactgtttgtctttaataaaaatggaggaagttgctgctgttttattaacttgcaccctgcatgcttctcttctttgttctttgttaaatatgagctggcgtgtgttaagactacgttagcatttgctctcagggacttctgtggtttctaaattcagcactgctaagcccctacactgtttgcctgaatcagttgagactgctatttttagcaacaaaagggaattgaaatagcaattttctttccatgtaatagattcccaagaggaatactgatgcaagctctctatcattttctattcctaccaccctcctcccaaagccctcagaggaaaggcagctgtcatggtttgcggcagtattaatctttaatcaatcgagtgttttctgcattcaggtgttcggggggaaaaaagagtcacaagaaggaacctgtttggaataactaagctcttaggcatggactttacagtcagaattttgtgggtagtggcagggaatagacagaagagctaaaaatagtgagtttgcttccagtgttgctctagtctatttttgatgtttgattttgataaggttgattgggttcttactaaaaatatctgttcctagcaagttgaggacaaaaagagtagaatatttttaacctacacaaactaaagtatttttgttgactgtataaaatctggaagtggagccctggtcagttgccagtattttatataatctgtagcaagctagacacttctggatgccaagttgggctattctttatagttgtcagtttccatcttctcaaaggcttgtaaatttgggttctagtgttatatttgtgtatgaagacataagcctttttaaaaaatcttcctttttccactttccttcttttcttcctctaccttatagtgccacccatgaccatcatctgtactgtcccaacccacagggttctgggtgataccatatagcttttttctgtgtattgttaaaagctaccctaacttatccacgtatttcatagcaaagtggaatctgaggacaccagtgttaaatgaagaagcaaatcttagagacaagaatagtgaactgtccggccaggcgcagtggctcacgcctgtaatcccagcactttgggaggccgaggcaggtggatcacgaggtcaggagatcgagaccatcctggctaacacggtgaaacctcatctctactaaaaatacaaaaaattagccaggcatggtggcgggcgcctgtagtcccagctactcgggaggctgaggcaggagaatgatgtgaacccggcaggcggagcttgcagtgagcggagattgcctgggcgacagagccagactctgtcccaaaaaaaaaaaaaaaaaaaatagtgaactctcactactttggtaatttagcatgtttggtaaagcatgttttggtaaaacatgttttagcatgtttcactggcacattatgagtgaagtagttctctctagcactgaaaatcatcacttgtctcttttttttctttgacttttaagttcaggggtccatgtgcaggatgtgcaggtttgttacagaggtaaacatgtgctatggtggtttgctgcacaggtcatctcatcacctaggtattaagcccagagtccattagctattcttcctgatactttccctcccccaacccccaccccctccaacaggtcccagtgtgtgttgttccccggaaatcatcacctttcaaggacagcctcagaattctttgaaagtgcaaatctacaggtttatcataaagttaaacttctctctgttaaagttcttgaaaatctcacttttagatgattcttgacgttgagaggaggctgaagagtgtaggggttgtgtaattatttctaaataaggtgtggaaaaagcagtgggtagggtcataaaaggttagttttccttttataatctccattcattcactcatccattcatacagtaaaacctcattaatcacctgctttttgccaggttctgtgctagcagttagactgtgatgatccagacagaccctgctcttacagaatcctgtgtgatgaatgtcatgatgatattgtccaaaggacgaccagcatggctagatagtaggaaagagagttttattggcaatatcagtttgcaaaacagagagtctccagcatgaaccgaaagcactctccaaaacaaaaagaaaaaaactagaggttttataaaaagaagaaatgttacctattgctctttgagaaagttcactggctttgggtaagggtttggggaactggcaagtcctgattggtgagcaactgctgtggacaaaattagttccagagttgcagcaaacatagataaaactggtgtcaggttacaacgagcagtttcagcagtcaagcttgcagagaattacattcttggagcaatgttttgtaccctaagggcttttccccctggcttcttgtctctgtttcagtcgggtgtgacaagagtgacccaactggcatgatcagctttcacaaagggggagttcggagtactatggggcagagaattctgtatgaggttctaagttagtctacaggtcaaggaaggcttaatgggagatgagacggtttaactgaaaaacctcaaggatgggagggaaacacagctagaagtgtgtcttagttcatttgtgctgctataataaaatacataaagaacagaaatgtattttctcacagttttgcatgccaggaagtccaagatcaaggtgctggtaagttcagttgtctggaaagggatactgtgtgtttccaggatggcaccctgttgctgcatccttcgaatgctgtgtcctcacagagcagaaggcagaaagttggctgaaggaacacttcatgaagattcttttataagggccttaattccactcatgagggaggagacttcatggcctaatcacctcttaatgtctccacttcttactactgtcacattggccattaagtttaacacctgactcttggaagggacacattaaaaccatagcagagtgtacgttggaggtgtagagaacattttcgaagagaaagcatgttaccttggaggaactgtaaaaatttcagcacaactggggcatgcttgagtggaaggaggaaagtggtaggagtaaggtcagctcatggaagaccttgtaaagaatgaggggagtgagaagccagtgacaggttttaggcagggaagtgaagttcagatttgcactttggagtgattgttttggctacaatgtagagattgaattggagaggagtaagaacgggaccaggcgaatgcgttagaaggctgttaacagtagttcttgtgggagatgaatgatggtagctctaggtggtagcaatgggaagaagtgaatgaatttgtgtttcagtttttatatagttggcaaaagggaaatgtaacttcttggcagagaaaaaatggtgtttgagaaagataatttttaactgtgtatagcatgaattgagtgaggagggatgaaagattcctcgtacaagtccttgtgtttgggatgatagcgtagattggggtagtagttgtgagaattacctggatgatatcagtgacataccttgagcaaatattcttataatgatgtgaatattattttgttttcataatttattttattgaccgtttacgcttacttttccgggcctatcatagttgctttaataagacaagtttatttttcacccactttaaagactagaacttttgtatatgtttgattccttatgataaacagtaaaagaagaaatgattgggattttaaaatggcgtggtaattcagtggtgttatcagggaccttgattcctatgatactgttccattatcttagcccatggcttcaaccctaagattacttcatggttcaagagactactgcagctacagccatcactttagaattgactagatgaagggcaaaaggggcctgtctctgccaagtcagcttccattaagcagcctttttcaaagtccttcacaaccttgcttcatgttgttccctgaaattaatcatatggccactgctagctggtagggaggttggaatataagtccttattccaggccacaatatgctgggttaaaaatcagtattctcctgcaaaggaagaagggaagaatgggtattaaggaaggcaaccagcaggctctggcccagatgtgcatttaacacatgaaggatggcctccccagggtagtttttgcacattgtatcttatcatttcagtgttgctgtgaatgcttcgtttttttcattttaagaaaccacaaaaaacaagcagtacttctgatttggatgacttggaagctggtctttgttttatttggttttcattgaaaattggtattataagggtgggagtgtttagatcagtgttttccaaagatcaaccaagagattatcttaggtaccacattgattaatatttttaaattttgacattcatatgttttttacactaatagtctatgttaattgaaactgatggtcctttataagaagcaattaaacagtaatcaagtaatcaagttttctattaaattttagttaagaaaaaatttcagttttaagaaaacttaagtgaccttgagaaacactgatttaaacaagactaccctgattttggaaaattggagtagatgagtttgctggctcagtttacaccatttttctattcatagtagcaaaggactttaaaaaaaaatgcagtacatgcacatggttaaaaaatgcaaagagttaaaataatgataaaaagtaatctctttcccatctttccctaatcccccagaagcaactatcaatagacttttgatttgagatgttatactttggtttacctttctaaaatttatgatgaagaattgactccccagacaatatagtttaattttaaaatagtgaaaatcacactattattttataaaaataaaaaattattgaacttaactgagggattttctttttctttttctttttttttttttttttgagacggggtctcgctttgtcgcccaggctggaatgcagtggcgcgacctcggctcactgcaacctccccctcttgggttcactccatcctcctgcctcagcctcccaagcagctgggactacaggcgcctgccaccacgcctggctaatttttttgtgtttttagtagagacagggtttcaccacgttagccaggatggtcttgatctcctgacctcatgatctgcctgcctcggcctcccaaagtgctgggattacaggcgtgagccaccgcgcccggcaactgagggattttctatccaactacagctgctatctctgctactactgttggaagacatatagctttaaggcaaaggaaatatatatatatatatatatatatatatttttttttttaaattgagacaggatctcactctgtcacccaggttggagtacagtgccgcaatcataactcacttcatcctcaacttcctgagctcagaggatcctcctgcctcagcttcccgagtaggtgggactataggtgtgtgctaccacattggctaattttcttgagtttttttttgtaggattggggtctcgctatgttgcccaggctggtcttgaactcctgagctcaagcattcttcccacctcagcctcccaaagtattgggatgagccactgtgccccatgaaaatacctttaaaaccaaaagcaggacaacccttattcccactgtcttaaataaacaaatttgaattttttccatgtttgttgagtaggactttttctttcataattgacttaaacttgggtatgtttgtatgttattgcaaatataatacattacccatcatgtaacttgtagatctaaaggctttgtcatttcctttgctggggaaatgatacttggtctcccattgcctgaccactgtgtataacactaattattgtagaactacagtggtgctatagagatggctaagagaggcccaggatttccagtttttttgtgtgtgtgttttttttttgtgcccataaataatttttacacttctctgttttctcagaaaaaatatttacttgtgaggtaatatttgacttacatgtaactgggcagtgttggatttggttttgagaagtatgagaaaatggaaaaatgatatttttacctgaaatatcagaggttaaatttttaatatttgtacaatgtaaagtcatattgtttctgcttatatttaaagtcctaaccatgaaatgggtaatttatagaatatctaatatcgaatgtggaccattgtattctcgatagtcatacacataatagtttctgaagactgttagtttcacttaaatttgatagttgctagcaggagataggaaaaaatgttcttgctgggcataaatctttctaagtatgtttagtatcattctcaactaaagttagtgtactttggtataatatgcttaagaggaaccttgggtgcttctagttttaaaatgatgaagtagcaatacttttgacctttcatctcttggaaatgttctctaaaggctggaagaataagaaatggaaagctccattttgatgcaactagggaacttctgtcatccctcatccccagtcacagctattgaaggtggtggagtggtaactgacttccagagcagacacctgagtcctcatagtggggccaccattgggaaacaagcaagttttgtcccttggatcccagaacagcacaggaattggaagtatcaggtatctcaaaagacaggggtggggcagatgtgcttgagactcagggaaattaagcagcagaagccctaagatgagacacctgactgagaacagaggatgagtaaaacacctgcaaactaataactgcccagcagccagaagactggaaattagggaatgctttttaagagacactgaagggccccacagaagagacagatactgacttttgtggattccccaatgacaaagctgattggcccgttgattgcattgtattgagggtcacagtgtaatcacctcacctatgaactctaatcgatattttaatgcagccaagatgagagtgaccaaaacaatcaagaaggaacttagaggaacaaaatataaagagtagaagaaaatgtaaatgtgtaaacaaactataattaatatcctcagagattagataatggatctataataagaacaagatgctgttaaaagcgagaaggagagtgagagtgtgcaaaagggcagtcggaatatggaagattcttcaaagtagcaaaattgacaacctacatttaaaaagtacatagatggtttggaagataaagttgaagaaatttataggaaagtagagcaaaaagaaaagtaagattaatagagaaactgttaagtccaaattccaatttatagggattctaggaagagaaaaatgtgaggcagatattattaaacaattaacataagaaacttttcagaactgaagatcatgaattttaagacccaccaatgcctagcaccagtgagtggaaaaacacccactcatttgggtgcattttcatgatggagttctacagactaagtgataattgtaaaagccccaatgataaaaaaaaaagcaggttacatagaaatggtgggaagtaagaatggtgaaacattttaaaatgatacttgcgttagaagacaacggagagttgtctaaaatttttttgttaaaaatgatttcctacttagaattctatacccagttaagctattatatgtgtggttagaaaatagactttttacaaaaagatatacacaatttaaaaaatgttgtcttttaaactgtcatataaggagacatgatgactaaatgtggtatatcctggatatcctggatgggatcctagatcagaaaaaggacattcagtaacaagtaaggaaatctgaataagatatggactttcattaattgtatcaatattggttcatgtgtatgtgaggtgtattcaggaatgttctcaggaataacacctgtgaggaagcaaaagaagcagaattgagcagagggagaaattgaactatgatgcaggtatagcaaaggttgtagctgataccattggccctgaacataggatggctctagagagatgcctaaatgaggtaagggagcccaacctttgtccctgagtgtggcctcgccattagacatgtactgcccaggggagcaaggcagcccgcctttggctgagagcagttactgggagagactcagtcctgagctggcagcaggtaacactcctggcaagaaaggattgattgagtacctctttgccggaagggaggatctggctggtgcactaacagtatccattacaaactccaacaactggagaatcaggaaaaggaagacaatatacatgaggcagatttcagaatctctagacctggcatattctggcctttctaagactgtttttagttttatggtatgctggtttttagatcagcccaaagttggcaattttaaacatggatacgcacatgcaacagttatctgtattcttttgaaagagattccagtcaaatgtttagatgcacagtactgagtgactttatgtagtttcattcttcagcatattttcattaagagatttctgagcccttaatctgagaaatctagtgatactgccatcaattcattgctgtaatcatatatatagtcatatgtcatttaatggtggggatacattctgagaaatgtgttgctagacaacacatttgttgttgtacaaacatcaacagcctgtacttctacaaatctagatggtttaacctactgttcatacctaggttatatggtatggcctaaagctcctaggctacaaacctgtatataatagcatgttactatactgaatactataggcagttgtaacacagtggtatttgtgtatctaaatatatccaaacatagaaaaagtacagtaaaaatatggtacaaaagattaaaaagggccaaggatggtgtcttatgcctgtaatcccagcttttggaaggccgaggtgggagcattgcttgaggttatgagttcaacatagcaagacctggtctctacaggaaaaaaaaaggttggtcaggtatggtagcatgtgcctgtagctacacggggggctaagacaagaggatcacttgagcccaagagtgagaggctgtagtgagctatgatcacaccattgcactctagcctgggtgacagagcaagaccctgactcttaaaaataaacaaacaaaagattaaaaatggcacatctgtctaggacgcttactgtgaatggaacctgcaggactggagtttttctgggtaagtgagtgagtgagtggtgagtgaatgtgaaggcctaggatattactgtagactttataaacgtttaatacttgggctatactgaatttatttaaaaattttttctttaataactagcttactgtaacccttttactttataaatttatcttgcttatcttttggacttctgtaataacacttagcttaaaaaagaaacacattgtatactgtacaaaaatatcttctttatatccttattccatttttaatttttgaaattttattttttactttttaagcttttttttgttaaaaacagagatataaaacatacacactggcctgggcctacaccaggtcaggatcctcaatatcagtgtcttttacctccacattttgtcccattggaaggtcttcagactcaatcacacacatagagctgccatctcctatgataacagtgctttcttctggagtatctcctgaaggacctgcctgaggctgttttacagctaacttttttcctgtaaagcagaaggagtatactctaatgtgaaaaagtatagtattatagtaaatacataactcagtagcatagttgtttattatcattatcgagcactatatgttatatataattgtatgtgttctacttttctattactggcatagttgtaggtttgttacaccagcatgaccacaaacacgtgattaatgcattacgttatgacattatgacagctacagtgtcactagatgataggaattttccagctccattgtaatcttaggggaccagagctgtatatgtggtcctttgttgaccaaaacattgttatgcagctgctgactgtatgtggtttgcttgctccacagttgtaggcttaatgcagaataatctagttaccaacaggatttgtaaataggtcagtggctaataggtgttagtgtaggaaagtgtaagatactgtacttgtaaataaagacttttgagaaaccaggttgtcaggaaaactgtccaagtcttgcgtgttttgcaactttttagaccaactaaatgccgatcatcatttaaacacttaccaaatgtctactgaacacctaccttgtgcatgttgcctagcaaggagactagaatcttacagaagaattaagacatgtagatgtaaggaaatacaattcaaaatagagtggtaaagtgccatagacttaaagatgtgccaagtgttgtgggagtttagaaagaggaagttttctttcacgtaaagtgatctagaacagtgaagttggtggatcttcaataaggctttgatggaagagggtaggaggtgaggttctgtgttggaaacagggcttgtggggtgcctgcataaactgcccataaaaataggggacaataagttctggaaagccacaagaggcctctgaggaggaaagcctcctaattgccatcatgttcccatgctcagagtgagagctgctctcttatctgtaaacactgtgttcaaggagaaagacactcctttgaagcgttggaatgtggacagatatgcaggctcctagttaagcctactcccaccagctactcttcgataagttaaagatatgctgtttgaacacaaaggagattcacttaaaccgccactgctatagattatgtgcatgacggactgccttccattcaccattttgccctgaacgtctgcttcttagatctaagtgactgtactcaataaaaagtgtggagaccagagctctgagccttttgcagcctccattttgcaattggctctctggcccccactctttatgcattcttaacctgtctcattccttcattgccactggattttgagtaccctgcgggtggtgttgaggctggtccccaacagttctggggtcttggagaggggagaaaagtttatcacagagaaaaggaagaggagaaaagtggaaacaattagaatatgtgtatccatcacttatgaaatgttagtgaatcaataacaagaatacagtataaaatttggattcctgtgcctctaaaaacagtcgggagatgaaaagttacagaaaattatgttcattgctactctagtcacaataccaaagacatggaattagtccaggtgcccatcaatggtagattgggtaaagaaaatgtggtgcatatacaccatggaatactacacagccatgaaaaagaataaaatcatgtcctttgcagcaacatagatgaaattagaggccataatcttaagcaaattaacacaggaacagaagaccaaatactgcatgttcttacttataagtgggagctaaacactgagcacacgtggaaataaatatgcaaacagtagacactgtggtctactagagggtggagggaaagggggtgagttgaaaaactacctatcaggtactatcctcactacctgtgtggtgggatatatacccacaacctcagcatcaagcaatattcccatgtaacaaacctccacatgtaccctctatatctaaaataaaagttgaaattaaaaaaacaaaaacaaaagttatgaattgatcatgaggttggaggagattttataagatgctcagttttctgtaattaggttctcccacaaacatttaaatctgttagttactaatgtttcctataaacaggacaatagtgacaaaaacacatgggttacctttggaagatgccagagtaccagtttattttgaaaactgataaataaaggcaaaaaaaaattcaaacatttatcttgtgttcttatgcaatctatatatcatggtaactaactaatgaggaataatttgtctctggaaatattccagctaatagatgaagatgaatgattgaactctaatatgaccattttgcaacccctaatgaaataatggatctcagtggtgaccagcagtggctgctaatataacaaaacaaaagataaccagacatatgcttcctgatgtaaaaatgcattatcccttatgaagtactcctaccaaaaaaatcaaacctgaatttgatcaatatctatatccaaccaccatgggacagaggaacatgttaaatggtatcaaggacaggctgagaaagcacaaacctatgacctaatatcttaaaccaataaattgagagggtgaagggaagaaaggggagaggggttatagacatggttaattgacatattaacaaattttattatggaacattttgaatcctgattggaacaattgttaaaagtcttttgaaacatttggcagaatttatagtgattacatattggatgtcaaggaattgttatttataattttaggaatgagataatggtattgtggctatttttcatagcagaaacatactgtaatagttatgaatgaagtgaaataatgtttttacttcaaaataatccagtgtgagaggaagcaggagggaatattagatgaagcaaggttaacctcaagttgttgattggtgaagctgagctatgggtacctaggggtttgttatactgttctctggatatttcaactttttttttcttttttttttttaattctggaaagatatcagctaagcaagaacatgatgaaagtctacaagattatgagagatatggctagggagactatgaatgtgtttaccatatttctgaatagtaaaattagggaccatcttgtataattggaaagaagtgaatacaagaaaatcctactttacaccataacttgtttttcaaagtctgtaaatgttttggaaaaactcgtatttagagaatttggggaggcatccctttttgaagcagacatctgtgctttgaacttgtaacatgattctagtattccagagataagatatcatggtatagcctgccctatataaatttcaatgtttctgctacataaagtttttgaggttgtaaggcaaatatggtttctcatagaataattaagaccattttctatttacttttactaccctttgttttaaaaagtagcttatgaagatatatacagtaagtatgtacttaagtgtacagctcagtgaatctacacacacacagtagtaactgccaccctgaaaagatacagaatatttcctgtatcctggaagattcccgtattgcccttccctgttatctactccactatccagagataaccagtattctgacttctgtcaccatagattagttttaccttttcttaaacttacatttttatgtcagactttttgtaatgtcttagagattcattcatgttttgcatatatcagtagttctttttttattttcttttttattgctgtttagttttgcttcttttgttttctcttttattgctgtttagtattccattgtttgtctatatctcaatttacttattcttctgtcgattaatatttagttgtatttacctactatgcatcaactaagctactgtgaacattctttggggtagacattaatgcatttctgtctcttgagaattggtgggttaaggtaggcatatttttagttctgaacatattggcaaatagtattttccaaaataattgtaccaatttacagtgccaccagcaatgtgtgagagtctagttgctccacattctttttaacacttggttttgaagtctttttaaaattttagctattgcggtgtgtattcaaccttagatttgaaccgctggtattgttctgtcttttacatcaaagtgtcacactggtccttttgtatgtaattggtgggtcctaactatgaccaattcctcaatgtaattcttagactaaactattgcttttttccctttcccagttgtcacaggtagtactgatggaattggaaaatcatatgcagaagaggtaggtgattttcaagatctttccttttaatataaaaaataagaataaatatgggatgatttcttatagtagttttgatttttgaagtaaaaaacacaaatataatgttgcatggtacaatagatgctttttgtttctaccttgttggaaataccatatttgcctaaacagacacaattttttgaaacaaatttcatgtaaaataagtataaaactttctggttgtactgggtagttggaactgggaacaatttagtgtaattttattttatgtcatgtaagtgtgtacagtcttcagatttgaaagtcaattattttgaactattttccaaaaaatgaaaatattataggtggttacatttctaggctagtccatgacatcattttcacaagaaggactgtgattaacagaaaggtattgatagacacaggcaaagggttcagattctctgcaatgaaattaaagaacaggagagcatcatagtttgaagaccactggacaaagcaggagccggggcagtattctttaggcaagtttccctgccttctggtccctgtgaaggcacctacagcctatgatgaagtgatctggaacagtggggtgattctaataaagatcccagcagattcactggatcttctatttatcattctcaaaaggtctttttgttaattttaatttttccagctttttatttggaagaatatcaaaactacagaaaagttgcaagaatataacaaacacctgtatactcttcacctggattcactaattgttaatatttggcacatttaatttactttactattattattaattatttcgctggaccatttgtaagttagttatagacataacagttcacccctaaatatttcaggatgaatcttctaagagctaaaacattcacccttacaaccccaatacattggtcacaataggaagtttaacgtgacacaatactgttgcataacatacagcccttatgcaggtttccggttgccccaatacatccttttaagctcttttttaatcgttgtttttccaagatccaggtaaggattatgcattgcatttggtgtcatgtctcttagtctccattaatctaaaagagtaagttagccttatttttcttttataagaatgccatttttgaaaaatccagtttagttgttttgcagacaaacttggatttgtcccattgttttctcattagattcaggaaaagcattttttcatcaggaaggctacacaggtttatccttctgagttcatcttattaggaggcaaaagaagtctcatttttcccattattgattataaacgtaattaataaggaatatgtggaatgacactttgaggctgtataaatatattatttcccaaaaatcttttatccagtggtgttaggattcattgatagtttttgcctagattggttattaccatggtggttaaaaaatggtgatttttggccaggtgcagtggctcacacctttaatcccagcactttgggaggctgaggtgggtggatcacctgaggtcaggagttcaagaccagcctggccaacatggtgaaaccctatctctactaaaaatacaaaaattagctggacatggtggtgggtgcttgtaatcccagctactcaggaggctgaggcaggagaatcgcttgaacccaggaggtggaggttgcagtgagccgagatcacaccgtggcactccagcctgggtgacagagcaagactctgtctcaaaaaaaaaaataagtgatttgtttctaatgctatatctcctacatttattaagatggtgtttttctataaaagcttttccttatccctcttgccctattaattttttaaaagaaagtatcagtatgggctaatggtttttttagtggtgttataacagattaatttcgcaaatcatcaccaacctttttatttttataaaaaatgttcttccatagcttcatttgcaatatcactcactacttaataaaccctgactttaggatttaagactggaatattagtttgctaaatcacttttagttgatagcacctaatttattgctcatttatattctgtctagaatatttcactaaatagttttgtgcagattagtgctttttttcctctactactatatttatgtgtcctgggatagtaaccacatttgtgtaaatctttttcattatgtacaacacttacatatgctgggtatgtacacagaaggtgttcctcaggaaattctttatttattcaattaacttctttagtttgccatggtccataaagtataatgctcaacttaaaattttaaaaataattatgtttttaggaatttttaaaattttagtagtagtttcctttgccagtcctctgatgtttgttttatatatccattctgcagcaaaaacttttttttttttttttttgagatggagtcttgctctgttgcccaggctggagtgtagtggtgggtgcaatcacggctcactgcagtctaaacttcctgggctcaggtgatcctcccacctcagcctcctgagtagctggaactacaggcatgtgccaccacacccagataattaaaaaaaaaaaaaaaatttttttttttttaattttttgtagagatgggattttactatgttgcccaggatggttttggactcctgggcttaagcaattctcccacttcggcctcctgaattgctgggattacaggcgtgaaccactgtgcttggcataaaacttttttaaagctaatttttaaattatagaagtggtagacacttaaaggtttaaaaaacccaaatagtatagatgatataaaatgaaaaagtaaaagtctccctccttctaaaaccctttcacatttaaatactagcttggcttagaaagataactttttggggcatttttttggtaaaatctctattttggattatgtcttcattacacttgggtttatattttgaactatcatctggacaggttttcttaaaatgggggttatagctcattaatgtttttcagtgacatgcacaggtgtgattcaaatctcctttactgtttcagttagcaaagcatggaatgaaggttgtccttatcagcagatcaaaggataaacttgaccaggtttccagtgaaataagtaagttctcacatcaaacaaaaggaatacatagctaattaatgttttcaagcagttatccgatactgacatagttatttctagttcaggaaacttctttttcaaggagagatatcattaaagagcatgaaaaagcacaggatgctttaaaaatggatcatcaattttaggctgggtgcggtggctcacgcctgtaatcccagcactttgggaggctgaggcgggtggattacctgagatcaggagtttgagactggcctgaccaacatggtgaaaccccgtctctactaaaaattaaaaaaaaattagccgggtatggtggcgggcacctgtaatcccagctactcaggaggctgaggcaggagaatctcttgaacctgggtggtggaagttgcagtgagccaagatagtcccactgcactccagcctgggtgacagagtgagactccatctcagaaaacaaacaaacaaaaaaagttttttaaaaattgttttagggtgattgtaatttgcttaaaatgtcttttactaatttatttttgtcttgtcagtagtcaaattatctgattattttatcgtattctgctgaaatgtctaaacttgtttgctgtgacttcatttcagtattcctgaatgttttttactctttttatctcagtgtttctaaatgtataacacatatgtgttaggaaaaatagaaaagatagcaatacccatgtgacagggaaaatcttttgaactttcttcttaggcaattatacttgagacctgaattacaatatggcaaagactcttaactaacttctactcaatcaaccagatggataaaccaatgctgttcatttgtttggtaaaacatactaactgatgtccccagtttgctgaccatttgtggccaggaagcttctgtgtataatgcttatatacttttatcctcacaaatcaaattgtttacttattaagagtcaatttgtgtttgtttccaaacttatgttgggtatattttttattaaatattctgtaaaatgatgaactattagtgtaaaagctagagttagttctataaaaactaagttgaatgctctaaaaaaagtgagtaaaattacttctttgaaaaattggccgtcaaattagtgttgaacaaagacaaatgtaaaatattggaagaacttacaaaaaagaaatctgctctcctgattgtttcatatgtgttgaagtttgtgctgtactttactagaactgaaattgtaatcataaatgatagaatatgggtgtgatgcatgcaagaaagactggaattcaagtccgcagatccaatctcaaagacaaggtcttggccctacacagaggattggtgaatgaattacatttatacatggtttaagtgaaaataaaatgattaccatgtgtatttatctctatgagtccttgttttaactaacttctcagctaacagatcgtccaaattctttcaatgagaattgatgagagaggatttcttctatattttgttaccaacattaccacctactgctaacatttatatagtgccttattatttattcattctctcacatgtattgtctcctttgattcttccaacatacttatgaggtatattttgttactatttctttccagaccatagctggtcctattggacagatagcttcacttcatctttagataaaaaacagagtgtattcgtctgtttttcatgctgctgataaagacatacctgagactgggtaatttgtaaagaaaaagaagtttaatagatacacatggctgaggaggcctcacaatcatggcggaaggtgaaaggcacgtcttacatggtggcaggcaagagagaaaatgagaaccaagtgaaagaggtttcccctataaaaccatcagatctcatgagacttattcactaccatgagaacagtatggggggaaccgcccccatggttcaattgtctcttaccagatccctctcataacacatgggaattatgggagatgcaattaaagatgagatttggatggggacacagccaaaccattcacagcgccttattggagattcccaatattaaatatgttatatctttttttttttttaattattttaaccttgctgagagtacagatctttacaaagctgagcatgtggtatatagatatacaatatatctttggcatttgaagcttttaacattcaagatttcagctatgtaaatgcaaccccaaagggccaagatatacagtattttacagttttgctgaggtctgaatctgaattaagccatgacactaatgagcctgaggtagttactgagatagtaggtgaatttaacatactgcctggatcttagcactgtttcattcttagcttcttgtagtcttgtatataataactcttaaagtgatttaaaaaatgttgtgtttgtgggtgtgtctagaaattgcctctcaatgaatgcatctactagttgctagaaataaaggtacataggcagaaagtagatgcttttgactaaatggaatgttgcattttgaaatgctatgatatgaatgaatctaccgtctactcgatacagaaacaagaaaagctacctcatgacactttcagcaagtactgcagcctgtacaaagattgctcagtgactcagaagatatgctttaatgatatttgagaatttggttaactcatgatatgaggtggcacgtgactgttggcagaaatgtgattctggagaaagagaggattctgttcaaacattttcatgaaggaacagatggtaaagacactgaattgacctttattaaaaggcatgggtttttatccttgttaaaatttttgaaaaatgtttttctgggcataatatgaatttaataggagaggtgatatcagcagactatgtcttctgttctaagctgaaaaaatacatagaggagatttataagttaagacagatttttaactgagatgtaaatcacctctttgggaggataatgtttgcatgaacatatttattccaggagaaagaaggaccagtatttaatattgtcaaagacagactaactctgcattcctttgattatacctttaacacatctttattgaatgcctgtgtaccaggtactgtgctaggcagtgaagataccatggtgaacaaggtggcatgcagtccctgttctcaaagaacttaagtgcaggagacagtaaaaacaaataggtaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacaaataggtaaaaaacaaacaaataaaccaaaccaaaaaaagcacacacaaaaaaaacagacaaataaataattgcagcctatattgaatgccacaaaggaaacaaagggctagagagataacaatagagaagttcttactttgttgcagcatggtgagttttgcgattcgcaaggtgataaaagggctagaataacggcctgttgcccatataacagcactccagtaacaaaactggagccttactgaaagacctatcctctgggcccatttgggggtataatggtggagggattgtgtgtgtgcaagttgcataggatacatgcactaacgtttctattttcttaagccttgttatgcaagggaatttatggccccccagtctcattaaactgtagcctattatggagtccaagttccaagtttcagtcagccaaccaagtcaaccaactatatgaactaaacattaaatcctaaatctctggtaagtgaatcataaaaatatttggcccaatctggtattatattgttttctgttgtgggtgtcagtgagggatatttgagttaagtcttgaggagaagaggaattcttttgctaggaaactgcccttactgttgtggtggggttattagaggatcttcaagccagagaacgccaatcttgggagacacaggcaggagaacagactagtactatttccactggaaagggaggttcagagtagcttgggagtccaagattctcagtttcagttgagtctgaccaaatatccccatcccaaatctcagggtcacactttttctcattcagtgctttcaaatgagactaggtgtctgtggaattcaacttaagttgtaattctgcaactggcacatttaaatctgatgttagcaaggtgaactccatggctataaaacataaaactttttactggggctaccacggaagttctctggttctctcatggtaaatgtgagctgacagtttagtgatctgaacttgccgtttttattctataagtgctccagtatattcagaagaagccacagcttagcacagtctttgtactcatcatttctgccaaactcaaatgtagccaccatttggtccctcaaggcacttctccagtgggtacttcattacaattaacagccagggttaatttgatgaactgtcataccacttattgcataatggattgctagtatcccatttcctattgggaaggggcttaacactatgtctaagcccaaggacacaatcaaaccagtgcaaaagtcctttgaagtttgtcttgtgatcctactcctgaaactaattcgtggatcaggcagcgcccagtcaggaaacagaagtcacacaatttagtttaaccaggataacttgtctcttctagtccaacatttaaactcactccaatgggttgaactcatcgttcttacttccctgtgtgactgaaagacaaaaagaggaaatgggggattgatgaggaaattacttgacaagtgaaaaaaatcaaggactttttttttggctgctctcaccttcgaaatctgtcatcatataaacttgggcactttatatcaagaagtaattccttatgaatgtggagggtagcctactcatcagtgtcaaaatttttaagaaaaattttgaatggattatatgtagttagtaggacactaaatgtttcaccaacaatggataagtgctttgtcaggattgactgctttgatgaaattacagttctttgtaaggatacctgtcacccttttaattaagacaagctgaaagccatcacacatgtaataagcttattttattatcattcttagccaggattattcatatattaaatatttttgccaattttgattcatcaaagaaaaaaactagaaatttttttaacactgagctgagtttttatttgcaataaagcataataaaaaggagactagctttcagaacaacctgttggttcacagattgtagagatggtgatatttataattcatattattttacagtcctttcttccttctcttttcgtttcatttcttttctttttttcttttttgagacagagtcttactttgtcacgcaggctggaatgcagtggcccaaatatggctcactgtgacctcaacctcccaggcccgagcagttctcccacttcagcctcccaggtagctgggactacaggcttgtaccaccacacttggctgattttttttttttttaaattgagacaaggtctcactctgtcattcagcctggagttcaatggcacgatcttggctcactgcaacctacgtctcccaggttcaagcaattcttgtgcctcagcctcctgggtaactgggaataagaggcacgtgccaccatgcctggctaatttttgtatttttagtagagatgggggtttcaccatattggctaggctggtcttgaactcctggcttcatgtgatccacccacctcggcctgccaaagtgctgggattacaggcctgagtcactgctcccagcctaatttttttgtttgttttttcttgtatttttcgcagaaacagggtttcgccatgttacccaggctggtctccagctcctgagctcaagcgatcctcccaccttggccccccaaagtgctgggcttatacatgtaagccactgcgcccagcccacggtcagtatttctgattggatgcagtttaataaactttgatttttaaaactgcatatttctttcttggatttaaaaaaatcaaaccatgagatttctcttttttgtaacttatctcagggtgtaaagcttttggatggtcctgtaactccatggctttatctcttgaaatgcaatgcttttttagaaatgtaaatcttactggtctatagtgaacagaagagtaggataaggtaagaaatgtccatttcactttttcaggccttacttggaattaaatttctatagttaagatatgaatttgaccaaataagtttgttccacaattttctgatgcagtaataataccattaatacgatgccttgttatatttagcttgttttgttttcataagtacaacaggaggcattagtaaacacctgtagaccttttcgttttatgtctaataaaactaaaaccacatgatgttaggattagagagttaatctcatatagccccatgagtcatatttttaaaactgcttctttaatgctagaaatatctttgttgctcgtagagtttatatgttacagggccaggaataaaacccatccattttgcctctactggttttgcccatagtacctgtaactgtagagatattctacaattttgtcaatgttcctggccttccagaaagtgacgttctgtactgcctgtaagacagactccacaaggcagtgagctagtcccaggatagtttcctgaaaggtctttgaagcattgtttccacataagagaatccttgttccttactagtgggcttgtcatgcttaattaaatgaaatttaccattaaatgaaacatttctgttatggtcatggttacaaaattgttttatctaattatatcctgatagggagaaggatagattcttactgagacaatgcaaataattacattgtcatgtaaaataaaagaactcaataaaggcatgttgtagaatatttggccattgctttgattagttttacagacaaggccaatcaatatgtgttgtattttctatataattaacatctttaaatttatctaatgatttaccagtttatatttcagctactgttgcagcgtaacaaaccaccccaaacttattgtggtaaaggaacaaccattttagatgctcacaagtttttctggtcaggaattttgtcaggacttagacaatccttttgctcctcatggcattactgaggtcactcagtgatattttgctgacggatggtctggtctggaagatctaagatggcttctcttaacaggtctagtgacttggcaggagatggccagaggctggacttagctgggactgttgactagaacacctacatgtagcctctctagcatagccatatcagggtaactggacttctcacatggtaactatattcccccagagtgaacattccaagagaaccaggcagaggcttatgtctttgttgcctggtctcagaattcacgtagcattattactaccatactctgttggtcaaagcagtcatgaatctgcccagatttaaggggagaggaatagactctaccatttgataagggagtggcatggtaactttggcaaagaacatatgggatagaagatattgttggaaaatacgatctggatttggaaaatacaatctgccagtttataagctatattaaagtttcccagggaatatttttcctgaattctgtgggatcagtaggaaaaacatagaattccaagagcgttcattgcaatttgcccaagtatggctaactaccatgagggttagtgaaaaattaagaagaaaaaaaagacgttttctcaaaatattaagttttttctggttctatttagtcttgcaaaattaatttttgttccattggtcagcagcatgcttttacaaaatgtttaattttggaatatagagtcctataaatactaactcaatttcctggtacaatttgtcagattgtctgcttttgtggcaatgttgggttacactgagcaggaagcctgacttacactgagaatgagttgattctctgcagcatcagtaatagccaagagtccagatacagcccttgctgaggctaattagtcttttgatgatcttcctaaagactctattttctgacattcagtttatggccggggcccttagacaagcttgaaggaaatgtagcaaccacctgttaataagactgatggttaatttattataataattaccactgtcagaatggaatcccctagtgggatataatatggaactaattaatatgatttagtcagtgattatcctgagggtatgagccttatcatggacattaaaggaattgatacctccagagactttcataatgtgtgtttttaaattgccaactattaagagtattttgtacttgttgataacgtaatcttagcaatcaatttgttcatagttgtgccagtctttgcatagaatcatgaatatgtttctattcatcctgaaaagtagtacatgttgagccatatttattattaattacaccttgcctacacataattgaccagggtgttgagcttctcttattgatttaatagttcttcccatatcatgggcttgataaacaaagcaggtctcataagagagctgaactaattaaagatgtggaatatgctatgtatctagttacacctaatgtcctccttgctcagtagtgctgcatagcggttaatcaagaagcactgaagatagtttgggtgtaaagtatatcttaacaattttatttttcttcatctgaggcccaaatttgtgaagagactaatcgttatactgacatataagcataagtcttaggtacccaagacaagaaatgattatagtcttaatttggtatgacagcaattaaagcatagctacaagaaataatggttattagcaaatctagcatatacagaaacaagaaacttttgttcgaaaatcattcaacaacatgacaaaagtcaacacaaaagctcaaaaagttaacaggctcttaggaagtgagagtattctaaggagataaggaacctttactagccaggctggatactgaggcgcatagtaattttgatagctttatcattaagagaagactatattctcaaagatcaattttcttctcaacaactggttccagacagtttaattcataagctttctttgttgatttcaatatattttatacccttatatatatatatataaggttatcttatatatatatatatcttatctacatataagatatatatatagagagagagagagatgacaagttaatactttcaactagcttaaaatacgttaactttacattctgtgattattcttcaagttgttgcacataccacattgagttctccatcctaactggagttttctgtatgaattttaatctttagaaattgtccagggcaaccaaagattctctttatttcacttgctgtgatatttgtatagtatttcaaggtcagttaagaattatagatattatatttaagttgacattgcagagcaacatgatcattgttgataccacgtttgtccaagaggtgatatttgaaagttttccacagatggcgtgaagagttacttagtttaaatgatttggggaatgtctgaagttcacaagtgtcaagccttggcattatatttcatactgtgataatatcagaagatatatagctatttttaaaattaaagttatcaaaccagttttaatttggttagggatttaccttaattaggagtgtaatgtgaaacttggattcttatataactctgaatttatttaccaatattagaaatgtttcaaaagtttatgttagtacattttaaaataatgactagttgttagccaaatatctgaattttaaaaactatcactgtttgagctggccatttctgtggggaatgatttgtctgagattgccagcacatttaaagcctcagaagttttgtccttgtctaataattttgagtttttttcttcttagatttaaataagcacttactaagtctctataagctatccagaacaggggcttttccaaatttgaaagagagaattgatgggcagtattgttcacgtcttctgtatccttattggtttcctttccactttctccatcaattattttgagaggggcaatgaaatcaccgactataattatggatttgtccttcacaatttttctatttatctgttattaggtgtattaacatttagagttgtatgtcctcttgatgaattcactctttatcattatggaatgaccctctttattcttggtaataatctttgctctgaaatctactttgatggaaatttactttgtctagctttcttttgattagtgttagcatggcatttctttttcctttaatctataagtgctttatattttaaatgggtttcttatggacagcatagagttgatctcgcttttttatctaaattgatggtttctgccttttaatcggggtccccagaccatctacattcagtgtcattattgattgagctaaaacctaccaattgctttttgtttgctatttattctgtctgttctttgttccctttttcattttttctgcctgcttttgaattgcatgctttttataattctaattttatttctatcctcggtttgctgactgtatatctttttttctttcttttaaaagtcttatatttacatacatattaacatttctgatgctcttcattcttttatgtaaatgatttcaatcaggaatcttttatttcccttttcccctgtctgaaggtcttcctttaacatttcttgtagtctggtctgctgatgattcattctttttgtatatctgaaaaaaaaaccctttacatttgaaaggtattttctctgggtataaaattatagatagatggtttctttttgttttctggtacttaaactactttgcttcactgtcttctggcttgcattgtttctgataagaagtcagctgttattcttaccattttatcaccatgcataatgtgaggtttttctcttttctggttacttctaagatttttctctttatcacttaagtttttttttttttaattattattttgcctcttcttgtagtttccctacttggagtttgttaagcttaaatttaagtgttcatagttttcggatagtttcttcatctcacactctttttctgggactttagttacgtatatattaagttgtcttaacccactgatgctgtctttagtttttatttgagtttcttttctctctgtgtttcatttttggacagtgtttatttatatgccttcacattcaccaacgtttttttctgcagtgtctaatctgctgttaattctgttagtgtattttaaatccagacattgtcctttttctctctgtattaaaatttctgccaattttatatcttctacaccttttctttttttgagacggagtctcactcttttgcccaggacggactgcagtggcactatctcggctcactgcaagctctgcctcccgggttcacgccattctcctgcctcagcctcccgccactacaggcgcccgccactgcgcccggctaattttttgtatttttagtagagacggggtttcaccatgttagccaagatggtctcgatctcctgaccttgtgatctgcctgcctcggcctcccaaaatgctgggattacaggcgtgagccaccgtgcccggcctcgccttttcttaacgtgctcactctctagtttcttgaacatatagaatatatctatcataattattttaatgtgtttagtgttttgtctacgagttcctcaattagtagactactaattagtagacagacttgactgctgggctctatctgaattcctcttctcctcataatggtctagaaaatctctccagactataagctagggtcatagggctcacctcatttgttttctttctcttagggacttctgtcatgcattctttattgtccaatgtctggaaaccattgcttcatatattttgtccatttttgttcaggctggtcaagtgatgtccagttttttagtttaaggccaaggaataaatctagtctctgttacaccgtcatggccagaagcagaagtccctctcccctcctttgttaaccatcatagatttcctggtaaatattaccatcattgcatgtgtccataaatgtttggtctacatcacacttttaaagagagacaaggacacaattcttttgtatttcgttgtaccaggcctagcatggtttaatgggtgtgggcacttagtaagtattgttttggtgactgaagaactactgtgaaacttcctcatgttcttactcttgcacagaaagatattttgaaatttagcttatggtccaattttggcacacatggttttttaagccaatatgagaccatgttgtaaaactgtctaactaaacgttttctctaagtgtagcttatttcaacttcattactgtttgttaccagtcgtttactctgatagagaaaaacatctgtaatatgggtggatattttgttaaaaatgtagcatacccaccaattagttggcccagctaaattagcatgtgttggtctgcatctccaattaaggcagctgcttgaatgttgctgttctacagctggcattagggatgtgggagtgtactccaccgtggccagacactagctgtacctctcaacatatttgcctatgtttgtatggtttctttaaaacagtaaagggtctttccaattggattattgatggttcagtgacttttgtgtaaaaaaaaaaaacactttttttggttgggaaatgtgggaccaaggtgttattaaatgagtaccatttaagtagagaatgtttcgcctcccacttttaaaatttggttgttgttctaagtggataattggaatttgaggtacaaccttcagctataaaagaatttgtagaatggcatattcttggaaacatttataaaatttagtagttttatgtggggattgcttcctttcttatcatgaaaagaaagtactttgaaacttttattgaaaaggttcactttaacttgatttttccatcaagtgaagttaaatattttcttgtcaattaccagttgttttgatcatcttattttgccattatttattaaatgcatatttttgttacatgctaatttttaaaataactacaaaccaattaggtaatttaaatgacctagcgttatgtctaatactagaatcaaagagaaaaggaattcattaacaccaataggaattttcacatatttgaattatttcatttctttgctattaaaagccaatagaattaatatttaacaacaccaggccactaagaatagaaaaaatgatatggaatcaacttttaatgtgctttcattctgtttaatgctgtagagatgtacaaaatctaagacgcaatcattctgcaatacctgatgaaagtattaagtcacagatgtaaatacatttaacttttatggaacacttaatcatattcaggcatgtttggaaaacatactcctcacatgatttaaaaggcatctctgtttaggaactgctgatggatcaatactctcattttataaatatgaaaacgaagtctggggagagaccaactcacatccagtgaatggcacaactaactgagttctaatctttgacttcttgtgctgtgttctccgtgactccatgcttttaagtgtactttaagtattgtaggtgggtaactgaataacttttggaaggtgcatccccaaaacgtaatgtcagaattacatcacatcaacagataaaacacaaactaaattaaatttgcagcatgactatgtttgaatgcaattgcctgttggagttattatattatttaattgatatatacaataatttttcctttttaagacatagccatgcccttgtattcatttatttagagacagagtctcactctgtaccccaggctagagcacagtagcacaatcttggttcactgcagcctctgcctcctggtgtgtccagagttggttccttctggtgggttcttggtctcactgacttcaagaatgaagaagccaaagaggttccccttgagtgttatatagcgcttaaagatggtgtgtccagagtttgttcctccagatgggtccagaatttattccttctggtgggttcatggtcttgctgacttcaagattgaagccacagacctcactgcgagtgttacagctcttaaaggtggtgtggacccaaagagtgagcagcagcaagatttactgtgaagagtcaaagaacaaacattccacagcacagaaggagaccagagcgggttgccgtggctggctctggtggccagtttttattctcttatttggccccgcccatgtcctgctgattggtccattttacagagtgctgattggtccattttaaagagtgctgattggtccatttttacagaatgctgattggtgcatttacaatcctctagctagacacagactgctgactgatacatttacaatcctctagctagacagaaaagttcacgaagtccccaccagactcagaagctcagctggcttcacctctcaccaggttcaagtgattctggtgcctcagcctcccaagaagctaggattacaggggcctgccaccactcctggctgatttttgtatttttaggagacacagggtttcaccatattggccaggctggccttgaactcctgacctcaagtgatccgcctgcctcagcctcccaaagtgctgagattataggcgtgagccactgcctcactgccttaaatatgctggcccctactgtgtatttaagcgtggctttaaatcagtacaattagtaactaaagaaagctaaacagtttttatattctaaaacaagctttgattaaaaacaaatagtcttacagtaatattttaaatgtttcctgaaaatataatgaaataagcatccatagttgattcttagagcaattatgaggacactgagacctggcaacgtcacccagtgcacagtaaagctgagcttcaattgcccatcacctaattgcaggtctagttctcattccacttctagattgtgatgttgatatttctaactgttcacccccttccagttttcctttatggtattaatctaaaatctcaaggcctcttgaatgtatgacattgtttttcaattatgaatcacttaaaatcagtgtttttgacttctatttctgaagtgaagaaatagaatggaggatgctgctgtcactacccatttctagaaagcctttattcagtctttgtgtgccttttactagtggtttatgtgcctggatgttagaccagcaatgtgggggccaccctcatgtgtgagtctctagctttcctcctgcttcagtttggctattttgctttgatcagttttgtaaattccattttgtattctttcgatagaagggcctattgcaataaagtgaaaatcattgctcagaaaattctccacattttctctaccaatccttattgcttccttccaacaaaggacttatattactcaaagtgtgtctctacgtgcctagccctctatcctcagagaaagaaatgccatcttctctaaaagctaacttttccctggtatcttgatccccagtgtcttcctggttccttaggacttgttcccatagcattcctctccatctgatatgtctcaaacagttacactatagacaaattttgttgagctgattgtttgttttaaaaatcagtacatttcacttactcaaatctgaatttatattttcttctgaaaatttacaggatctgttaaccctgggcccagcattcttgcagggcagcaatccactggagctgtgtcctttagatgggaatgctcctgtcaagttagcccagcccactcatatagtgcagcacctacttgcttttattaggacctcttcacttgcttaagtaatggacttggcactgatgacatttaactctctgccgggcacagtggttcacacttgtaattccagcgcttgagaaggccaaagtgggaggatggcttgagcccagaagttcaaaagaccaacctgggcaacatagggagaccgtgtctctacaaatataaaaagtacaaaaatcagccaggcttgatggtgtgcacctgtggtcccagccactggggaggctgaggtggaggattgcttaagcctgggaggttgaggctgcaatgagccactgtctcgtcactgcgctccagcctgggtaacagagtgagaccctgtctcaaaagaaaaagaaaaacaagtttgcagtctttattatcctttaaggcctcttagccttgcaggacatctaaagagaaattctatattgtttgcaagccatttcagaatatttgtaagacgcatagaacattttagtaataggatttgccttattttcagtgaaatttatttcttctattatggtatatttataaatattctccactaattttgcttttgtcacataacaaatatctatagatatgaatactaaaacaatgtaaacttcggacataggaaaatcacaaaaatacgcatgtacaggttagtgagtgattagagagggagagaatcacacgctccctactactttttgtttttctccccagagggagccactatcttaatttctaacattatcatttaattttgacttcttggactttatagaaattgtatgatacagtatagtttcttttgagttttggcttcttcagctcagcattaatgtttgtgacattcatccatatttttacatgtagctataattcactccttttaatcgctttatgaatgtattacaatttagttgtatatccaattgttgatggacttttgggttgcttccagtttctggctattatcaataacgtgactatgaacaatactgtacatgtcttttggagcacatatatacattatatacattcatttctgttggatatatatgtaggagtggactcatattcttttttttttttttttttttttgagacagagtatcgctctgtcacctaggctggagtgcagtggggcaatctcagctcactgcaacctccacctcccgggctcaagtgattctcctgcctcaacctccccagtaactgggattaaagacacacactactatgcccaggtaatttttgtatttttagtagagatagggcttcaccatgttgaccacactggcctaggactcctgacctcaagtgatcgacccacctcagcctcccaaagtgctgggattacaggtgtgagccactgcgcctggcctcacattcttgatagtctctttctcatgtataaagcattgctgtttctttcaagatctttggtactgagataccgagtacatttctcaagatcatattacaaatatggtagcagactcagaatttgcacctttgtttcttctataaactgtcaccttaaaaacaaaacaagacaaaaccaaaaacatttgatgagacctgtaaatctaactattttcatttattttggtagtttttataagttttacaagtaattgcatatatatatatatctctgtctctctcgaaagctgaacatctaacctttttatttaactgctttttaaagttttcaacctacaaaattttatctgttggttcatgtggaagtttaccttcatttagcatggttccaagtgttgagtcgttaatagtgaggagacataaagtacattttaaagatcctgttgatggagagtaaatatgttgcagcttactgcattaattggaaaataagccatcataaaatccccctactcctgttttctcttaaaagttcattcttgaaaatgtcatagaacaaataggtgtgctcgtttaagttggtgtgtactaactatctcagcaaatgatgagttaaaaattttggggttttttttggcattgccttctttccatcaccccttcatgcacagtgttaaaacattattaattgaattttctcttggcacaattacaagatgacttttgcaaggagggcttaatgttatttaaatcatcattttacatagcaacattgcctctgggacttttatacaatgcaactgctttggtagatgaaagaaatcaagtactgctgcacagacttttaggagtgttaatatatttaaaaagcaagtaaaatgccgatgtactagcttgtgatccagtatgaatggaaaataagtccatgggaatggttactttttcttgaatagaacagagtatcatgggaatgtgagctatttctaatctttttttgtgaatgagttttctttagattaacagattttcacctgatttggggggaaaagaaaaagctttcagccaggcatggtggctcacccctgtagtctcagcaccttgggaggccgaggtaggtagatcgcttgagcccaggcgtttgagaccagcctgggcaatatagtgagaccccatctctacaaaaatacaaaaaaatagctgggtgcggtggcacgtgcttatagtttcagctgcttgggaggctgaggcaggaggatcacttgaacgtgagaggtggaggttacagtgagcagagattgcgctactgcactccatcctgggcaacagtgagaccctgtctcaaaacaaaaaactccacaaactttcaagccattttgaaaatgttcagaaatttcttgaatattttattaagaacattttatcttactagatttgaaaaatattttgtggtttatttattcattttaaaaatagaattaaaaaaatttttttcagagataaggtcttgctttgtcacccaggctggagtgtagtggtgtgatcatagctcactgtaactttaaactcctgggcgcaagcaggtctgcctcagccacccaagtagttagcactacaggtgcacaccactatgctagctaatctttaaatttttcatagagttggaatcttgctctgttgcccaggctgctctcaaactcctgacctcagtgatcctcccaccttggcctcacaatatgctggaattacaggagtgagccactgtacctggcctaaaatcgactttgtttcttagagtagtttgagttcacagcaaattgaacagaaggtaaagagacttcccaaatactccgtgtccccatatgtatgcagcctcccctactataaaattcccacatcagagtgttagattagaacctatactgacacatcgttatcacctaaagttcatagtgcagtgtaaatttttcatggccttggaaggaatacatttaaatctcaagtttttgttgtatataccacctacaaaatgtttttcctagatgtctacattttgattccttagcttatttctcttttgactttttgaaaatggaatagaaagtatattttttgctttttgcccttttatgtttttaagtttaacattaaatgtctttggaaaatatattttactctatgcctctcttttctgtttctgttgtacatcgggtatagcctgaaagggatccaggtagatcctaggtcacatatgtgtatgcttatagaaaccaggctggtgataggaatgatctaagtgggctggggtgaggcaaaactgaacacatgccccatgtaaaggtgtcagctctagctgttactacgctgtagggcaagctcaggggtgccacattttccaatttttttaaagaatttttaaagaaaaccaagatgttttatgtaagactttgtaattttttttttttttgagatggagtctcgctctgtcacccagctggagtgcagtggcacaatctcggttcactgcaacctctgcctcccaggttcaagcggtactcctgcctcagcctcccaagtagctgggattacaggcacatgccatcacgcccagctaattttttgtgtttttagtagaggcagggttttaccatgttggccaggatggtctcgatctcctgacctcatgatctgccccccacggccttccaaagagctgggactacaggcatgagccaccacgcctggccaagactttgtaattttacatcagccctaattggaatgaaagaaaactgagggtccaacaacccatggaccactcttttcatttatttatctttatcaagtcattatttctataacaattaaatgtgctagagactcttcgaagaggtttatagaaatcaactcattgaatccttgaaaacccctttgagattggtacttatattattctcatttgagacatgatccaagtaagatacagaggggtaagaattccaaggtaggtggaattctaagatgttccccaagattctcaccttcaggtatatacaccccatatgattcccttcccttaagtttaggtgggacctgtgagcatcatggatgccattcttgtgattggttacattatatggcaaaggcaatgggagtttatagatattattaaggtccctaatcagttgactttgagttagccaagaaggagattatctctggtgggcctcacccaatcaggtgagcactctaaaagagggcccaagtggagacttgaagcaggagaaatcctcatattttgaccttgaagaagtaaactgccgtcctgtggggagggttatgtgacggggaatggcaggtggtctctaagagcagagggccccagtcttacaactgcaagaaactgagttgtgaacaaccagtgaacttgaaagtggcgcctgagccttagatgaaatcctagcctgatgagaccatgaacagcggagtcaattacattacagaaacagagagataatacatatatattgttctaaacagccaagttctgtggtaattgtgatgcagcagtggaaaagtaatacatactcctaggatcacattgctgatgagcgacagatgcaggttttggatccaggtgcccaactacagagcgtgctgtcggggatcatttggtggctcctgatccagagaactctttgaacaaataattttaagaattttttttttaagtttcaactcttttgtgaacacaaagtttatattccattctatgaagttctgctttctaaatccacttttatttgcaactcaaatttatttcttttttatttatttatttatttattttttattattatactttaagttttagggtacatgtgcacaatgtgcaagttagttacatatgtatacatgtgccatgctggtgtgctgcacccactaactcgtcatctagcattaggtatatctcccaatgctatccctcccccctcccccgatcccacaacagtccccagagtgtgatgttccccttcctgtgtccatgtgttctcattgttcaattcccacctatgagtgagaatatgcggtgtttggttttttgttcttgcaatagtttactgagaatgatgatttccaatttcatccatgtccctacgaaggacatgaactcatcattttttatggctgcatagtattccatggtgtatatgtaccacattttcttaatccagtctatcgttggacatttgggttggttccaagtctttgccattgtgaataatgacacaataaacatacgtgtgcatgcgtctttatagcagcatgatttatagtcctttgggtatatacacagtaatgggatggctgggtcaaatggtatttctagttctagatccctgaggaatcgccacactgacttccacaatggttgaactagtttacagtcccaccaacagtgtaaagtgttcctatttctccacatcctctccagcacctgttgtttcctgactttttaatgattgccattctaactggtgtgagatggtatctcattgtggttttgatttacatttctctgatggccagtgatggtgagcattttttcatgtgtgttttggctgcataaatgtcttcttttgagaagtgtctgttcatgtccttcgcccactttttgatggggttgtttgtttttttcttgtaaatttgtttgagttcattgtagattctggatattagccctttgtcagatgagtatgttgcgaaaattttctcccgttttgtaggttgcctgttcactctgatggtagtttcttttgctgtgcagaagctctttagtttaattagatcctatttgttgattttggcttttattgccattgcttttggtgttttagacatgaagtccttgcccatgcctatgtcctgaacggtaatgcctaggttttcttctagggtttttacggttttaggtctaacgtttaagtctttaatccatcttgaattgatttttgtataaggtgtaaggaagggatccagtttcagctttctacatatggctagccagttttcccagcaccatttattaaatagggaatcctttccccaatgcttgtttttctcaggtttgtcaaagatcagatagttgtagatatgcggcgttatttctgagggctctgttctgttccattgatctatatctctgttttggtaccagtaccatgctgttttgattactgtagcgttgtagtatagtttgaagtcaggtagtgtgatgcctccagctttgttcttttggcctaggattgacttggcaatgtgggctcttttttggttccatatgaattttaaagtagttttttccaattctgtgaagaaagtcattggtagcttgatggggatggcattgaatctgtaaattgccttgggcagtatggccattttcacgatattggttcttcccacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgactgttgttggtgtataaggatgcttgtgatttttgcacattgattttgtatcctgagactttgctgaagttgcttatcagcttaaggagattttgggctgagacaatggggttttctagatatacaatcatgttgtctgcaaacagggacaatttgacttcctgttctcctaattgaatgccctttatttccttctcctgcctaattgccctggccagaacttccaacactatgttgaataggagtggtaagagagggcatccctgtcttgtgccagttttcaaagggaatgcctccagtttttgcccattcagtatgatattggctgtgggtttgtcgtagatagctcttattattttgaaatacgtcccacaatgagaacaaagacacaacataccagaatctctgggacacattcaaagcactgtgtagagggaaatttatagcactaaatgcccacaagagaaagcaggaaagatccaaaattgacaccctgacatcacaattaaaagaactagaaaagcaagagcaaacacattcaaaagctagcagaaggcaagaaataattaaaatcagagcagaactgaaggaaatagagacacaaaaaaacccttcaaaaaattaatgaatccaggagctggttttttgaaaggatcaacaaaattgataaaccgctagcaagactaataaagaaaaaaagagagaagaatcaaatagacacaataaaaaatgataaaggggatatcaccaccgatcccacagaaatacaaactatcatcagagaatactacaaacacctctatgcaaataaactagacaatctagaagaaatggataaattcctcgacacatacactctcccaagactaaaccaggaagaagttgaatctctgaacagaccaataacaggatctgaaattgtggcaataatcaatagcttaccaaccaaaaggagtccaggaccagatggattcacagccgaattctaccagaggtataaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaactcaaatttatttcttcaagtttttctctttacaagtatacataccatgaaaaattagtttattaaaaagtaatatatcttctgtattgtgaactaattttaatatttataatctcttaggaataaaatgttaaacactgagcattttagaatatgtatttactgaaagctttttgtggtattgtagaaagtttattttctttgattcaaattttttaaagatgatataatattttagaatttggcagtttaattaatgaggttcatctcaaatattttgaccttcaaaatttatggcttgccttacatttcaaaatcatgagatagaatttatcttttatcactttgtcttcatctagtttcaaatatgtggatgtgaaatgagacctgcttaaattagtggagaggacatggtgtggagtataatctaccaagtgggcaataaaaattctaaggaaaacataataggcatttatcaattcttcttataggcattaatttgactgatcctagttactaattattaaggattactaagattctgaaattgcctgaaatccaggcttaaaaacagtgttctattttggaatgggaaataaacttacaacattggttttatgcaacatgctctttaaaataccaagagctgtttctggaccatgatactatgaccatggattagtcattaggagacccagattcatctgtcttcctctgtgaatctttgtggcccgagataccttgctgtctattgtactttgtgtaaaacaggtgtgactgaattcacatctgtgattgaagactctgtgttccacataagtgagaagattgttttaaggatcaaatgagaatgtattggagaacattttgaatgtaaggcgagtttaactttcagtctttgcctttgctggtataatatgttcattgctttaatgggccaaaatgagaaataaaactgccagctgccctgaacagtaggcaaaatattttccacatgatgcattaccgctttcacattgggtaggatgttcaaggagagttactgaatttcgttcatcttactactgtttatcatcctggtatctagtacctactgataaagaaaacttggtttcttttttcattttttatcctaattggctgcagaattattggtaatccagtgacatttgcaaaataattttgctgacctgtatatttgagatagtctctgagatttcatgggaagtattggtagcaggatgcagatgatctgctccctctcatcccccagtgccctctccactccctgttgctgcatatcatattgccttacacactccctgctgctcaggatatcatctcatgtgtatggtattcttttattttttgagacagaatttcactcttgtcgcccaggctagagtgcaatggcgtgttctcagcttactgcaacctccgcctcttgagttcaagcgattctcctgcctcagcctcccaagtagctgggattacaggcacccaccaccatgccaggctaatttttttatatttttagtacagacggggtttcaccatgttgaccaggctgatctcaaactcctgacctcaggtgatccacccacctcagcctcccaaagtgctgggattacaggtgtgagccactgcccctggcctatgtgtatcatattcttatcatacatatgttacatatgtaatgtatgtgcataccatacatatgttacataagcatacatcaattaggctgctcaggatatcatctcatatgtattgtttttagtctttctaaggaaaatgtttagaagctagataaagattattagaacgtgagttatcacctgtctttaccattgccactgggataaaataggtgaccagggttcacaaatactccagaatgctctggctcagcatggttctttaatgcattactcacattcttttctttatgacttcgtgcctttggctgttgcctgtggtacatcttttgtcaaattcttcctgcacctttccccaaggtgaccttaactagaatatatgtggccctgccttggattatgatttgttttacatactttattttttatatatattataacagatatgtatattttataataaaaatgccatatctttggcatgagaaggaatcccagaatctggggcatatgtgcatgcagactagtcgcacctataactccttctcctcaaactgtgtttttggctttggtggtaacaaatataagcattctgcagtttccctgttcttatcttgtcttccccccaacgcctcctcataaggtcttggtgacctataaaatttcctctgaattcaccagcttcacctattctgttgctcttaactttccatgatacaatctccttctccaatacaatgaattcttcctttgatctgtgcccttaacgctatgtttttgatgcctgattaaagaaattatggcatagctgttctatgtaatattatgcaaggatgctatgaaatcattaaaaatgtttgtctgtatatgctgacatggaaggtcatctttagtgaaaaaaaagcaagttgcagaatagcatttttagagaaagtctggtctgtcttttgttttaaaaaaagaatacaccacattcacacaaatgccaaactcatgaaccaattctgtttgtagataacatgtagatacacatcaaaaaagatctgcaagataacagcccagacctttcactgtggctatctctgggcagtaagaaaaccaaaaatgcttattatttgagtgtcatggaccttcttgtgaattcaaatggtaaaacgtttattcctacaaaaataaatatatatacatatatatacacacacacacagaatattttgccaacaattttagggagtttaggaagtttccttactgtccaaatcattcccctgaattttaaaaatgaaattttattgtatattaagtgtaattaactaatgctttttaaggccaaatttgtgttctgttagtcacatatttataagctgtatatgtactttatagttattggatccttcagacaatcagtatttggaaacataattttactattttaaattattccagagactaatggtattatatgtgtgtatgttacagttattaggtttaactctgattgatttaataacaaattccaattataaaattgtttctgtgggcacatatgatctacttttcaatatgcatttgatacactttctgggaatgctttaggcaaagcgtggagttgcttatatatcattagcatgaaacttagtaagtattaataactgagaactcgttttgcccctacaaagctcacatatttatttagaccctttatccaccaagtgaaggtcacaaataaagctatctcttctcaaatcaaggcttaaattagagcatttaatcagcctgtattatgcagcatagatgtcaaagatacttgaagggatttccactatccagcttgaagggatgctatctaaccaaacctggataaattgagcattaaaattaaaaggatggaaacaaattataatctgttaattaaaatagaaaaccatggccgggtacggtggctcactcctgtaatcccaacactttgagagcccaaggcaggaggattacctgaggtcaggagttcaagatgagcctggtcaacatagtgtaaccccgtttactaaaactacaaaagttagctgggtgtggcacgagcctgtagtcccagctacttgtgaggctgaggcaggagaattgcttgaaccgggaggcaaaggttgcagtgagccaagattgcgccactgcactccagcctgggtggcagagagagactctgtctcaaaaaaaaaaaaaaaataggaaagcatgagcccattgtaattatgataagtaaatgaatgaaatgaaatttttacaaggaatgggatttaatgtagtcttaaagtatcttcctacagaatacaaaaacttgcaaattaaaaaggaaataatagtaacttttatagtggaggaaactggcagacactaccttaataagagacaaaagttatcatcatcagtactgggacaaatcaaaatgatgtgccacctgatgggatgcagtgagaaacacagcatcacttctgtgatattctggccaaaagtgcatatcctgaatctaatcatgaggaagcatacaaacctaagttgagggacattctacaaagtaattggcctgtaataatcaatgtatcaaggatatgaaggtcaaggacagggcagaaagactgttccagattgaaggaggctaaccagaatggtagctaaatgcattgggtgattctgacttggatccttttgcagtaaaggatattgttgggacaactagtaaaaattgacaggctctgaggattagaagatagtaattattcatcaatagtaattattcctcaatgttaatttcttgatttcgatggttacatcatttaggagactgcagtaagtacatactaaggcagcattctcaaactttttagtctcagagccctttttactcttaaatattattgaggactccaaagagctttttttttttttttacttttttttttaaattatactttaagttctgggatacacgtgcagaacatgcaagtttgttacataggtatacacgtgccatggtggtttgttccacccatcaactcgtaatctacattaggtatttctcctaatgctatccctctgcttgccacccacaccctgaacaggccctggtgtgtgatgcgcccttccctgtgtccatgtgttctcattctcattgttcaactcccacttatgagtgagagcatgcggtgtttggttttctgttcttgtgttagtttgctgagaatgatggtttccagcgtcatccatgtccctgcaaaggacatgaacacatccccaaagagcgtttgtttacataggataccactatcaatgtttatcacattataaattgaaactgagaaacttaaaaaataattatttaactcacttaaaaataataacagtaaaccctttacatgttaacactacacattttgagggaaaataactatatattctgaaacaaaacaaaatatagtgagaacaaccacatcattttacatttacaaaatctctttaatatctggcattgtagcaggatgagccacagacaaaactcctcagacaccggattaaagaaggaagaggatttattcggccaggagcatcagcagacttgcgtcttaagagctgagctccctcaaaaagaaattcttggcccttttaagggcttacaactcctaaggggtccacatgaaagagtcatgatagatcgagtaagcatgggaaacgttactgggggctacatgcataagctaacagaacagaaagttttgcaatgctttttcatacaatgtctggaatttacagataacacaagtagtttaggtcagggattgatattattattattattattattattattattattattattattattttaactgccagggccagatggtgacaccaggccatctggctatttatcttctttttaactttttgcttttttcttttcctcctgtcttataaactagacaagggcaggtgggggtggggggcagcaggagaaatggtggtctccttccttattccccccttggagaatttcacttattagttgaagttctcacttttatttttactttctgagtctctttgtgagacagagtgatagtgattcatgtaatacacttgtgctgaagttttctgatgaaccagggtggcaacaaaaccttttatcatttgaaggagcaagggtaatacgcaggggagcagcaagcaagttcttattactagcagtatacttacaatgagggttttaaatcttcttatagctggaaactatttttctaaataaagacttaggattaaacctgtgctaaacctgtacagacacatgtgccaactttatcatgttctaagcaggtttgttcttttactgggtcttaaaagcctttttttagtgagcagcatagtatttcttaataacagaactttttaaacgccagacactggaacttgtgagcatctgtttggggaaagagtcagttaaattaaagttatcttgaggcattaacttttttgcttcttaaggctattggtctctcatgttagcttttctataaacataacatgaggaaatgcttaggctgctgacagtgttttcagccagctaagtaaacagggtttttttttttgctaaatgaggaggctctggtaacttctggtttatatgcttaaagaatgacttaaagactcagaattgttgctgggccagacaggttcgggttacttgaccaagtagtgtgtgtacagtggggacatctttctataggtgtttcttctagcatggttaagggggataacaacaacaaaacaatatacagcatattcatatctagcaaggacaaaagaggtccttacctgggaaaaaggttgaatacagcgacagaacaataggaaaacagttaatattacatgaaaactattagtcttaagatttttaactacatttacttgcttgatgagtcctcaagctttggctgtgcatagactagtcagcttccaggatgtgactagagcagagcttgctctagtccaaacagtttagtctaaaacatagttagatttgcatatctacttctgcattcagtctgctgcaatttgttattttggttgaagtagaaggaaatctggctttacatggatgcgtagttggagaagagaaagctattttaatagcttctttggatgattgtggatattcttttggtccatcaaaacattctaagtgaaagcttcttaaaagttagttgcaatatggaatctgaaattatatcaattttttacactgagtgacattaaaatattaaagttcattgttctacctcatagtctgaataggtcttttatccatcatgactttgtaactttatgcattgatcacttggaaaatatttgttcctgaattttgcagctcttccaaatgttgacacagtatcaaagataatcacaattgttaatattacccccaatcttatcagaaaagttttttctcttaagctgatgggggtggatacaagttttccaaaacccttattttcatttgaaaactcaaatgttatcatggacaacaaatactgttgcttgtttttcttgaagtgacaaactaacctcattcatttttgataatatgcctgccaaattcaaataagcatcgtttttctgtcagttgttctttcatataaagtgggttgcgtgaaaaaaggggctaattcaactcacgactcaattgcacaaatgcttttcctcaagacagccattgtattaggaacacagaaaaagtgcttcatgcatactttccattttgtcacacagaacaataaaaagatttgtactcaaatagaggtttaacaaaattaatgattttcactgcttcatcaagggatatttttaaatgaaactgacttttttcttttttactacaagtatgtgaagaatacaatgacttccaatacagccgggtgccactgctttgattcttgtttaggttctagcagttttacccaccattgcttttctcaatatagtgaagagggcagagaatgtcagtatttttgactctcagggatcatggaccacattttgagaactactacatcaaagtatttttgggtgctgggcatcatgtcagcaatttaatctaaaatgattcaggggaaaaaagttacttgtagaatatttacagctttcctggtttgagattatttcaaaatttaaaaaacaacatgacctttcaaatgttgaaaactgatatttgtgagaataattattttaaacttcagcaatataccagtaagttcttgtacagattggataacttaatgttatttagtagcattcttggagtatagtcaatgctcagaaattgataactgtattattactcctgtcttgttggtagaatattaactatatctctatacattttatatggtacctttagggaatcctagggtcaaaatgactttgttctttgtttgtttgcttttgagacagagtcttgctctgttgcccaggctggagggcagtggtgatcttggctcacttcaacctcctcctcctgggttcaagtgattctcatgcctcaacctccagaatagctgggattacaggcatgtaccaccatgtcaggctaatttttgtatttttagtagaccctgggtttcagcatgttggccaggctgatcgcaagctactgacctcaggtgatccacccgcctccgcctcccaaagtgctgggataacaggtgtgagccaccttgcctggcctttaaattcttattctttgttctgaaagtgttgcagaacagattgtgtatcaactgcctttgcttttattttgtattaatatgtaaaaactatgctcttttggtaaatgaagagaggctgttttctgtgttgaacagaaagattattctactcttgacaaaatattgttgaactatcttgatctaagcataaatggcaatgaagtaaatacttggccgggcacggtggctgacacctataatcccaacactgtgggaggccgaagcgggtagatcacctgaggtcaggagatcaagaccagcctggccaacattgtgaaactccatgtctactaaaaatacaaaaattagccaggcattgtggcaggcgcctgtaatcccagcttcttgggaggctgaggcaggagaattgcttgaacctgggaggtggaggttgcagtgagctaagattgcaccactgcactccagtctgggtgacagagcaagactccgtctcggaaaaaaaaaaaaataataataataatagtaaagtaaatactcatttcaatagctattttaaattttatggtgagttttctgcccccaaagttccctttttaaagaaaagaaataaaatcaactgttaagcttcttttttctaactaccaaagtgggagatccagaccttgaaaagaataattttttcctgtggcaagattttacaaaaccagagtggaatctcataagaacaaagtgacaggttaaaataaaaagagattacttttttaaaaaaattagctcaatcagcatttttaaaataaaggtactgtgtgatatttgacttctaattaattttagctatctttatgtgtgaaagaagaagggagaaatagtatggtgggttacaagaatatctctttttgctttctaacttgatttgtaggtcacggttatcctgcatggaaaattggtcagctctggcccaaatcttcttggtagtcatttcatttttcaagctaacaaagagagagaagtaacttacctcaagaaaagattcgttttactaaaaaataacagagagacacatttcatatgattaaaaaaaatgctgagacataatcacaggaacattgcctcatatgcagaactagaaagactgttttagctataaaatgtgatgtttcattaaccagatttctaaagcaaatgtttatacattttataacccttgtgttctgtctcttcatagagctgtttgtctgctcagttgtacagtcctgtgggctctcactcagaagtccctcccagcctagcctgccttcctcttcccactgctgtctctctctccatgggaccctcctctctcacgggactaatgaagcagctgctttgttctctgcctgccacctgtcgctttttataacaagctgtgtatcttctactctgccaccgtcatttccttcctcaaaaaaaaaaaaaaaaaaaaaaaagaagtgtgatcttgtaacttcccagtttaataacctctcctaagtaattgtaacacacaggaggaaatataaacttgttataggaccaattccataggcctgtgacctgagcatttgcatggagccccacacttagaagggtccatacttggtttaatgctctgctattgccatcttgaaattcttaataacttttgaatgagggggccccacatttttattttacactgggtcccacaaattaagtagctagtcctatttgttatcttggaccatacaacctccaccagctgtcttctacgaattttctttccgcttctctgtgccatccacagggattcttaaaacatgctgttcgttttctgcactttctggttttgccaacatctgccctttcttgatagggtcaattcctactcttcaccaaaaactccacacaaatgttacctagtaggtaaaatagcactctgcaagaatgagttgctttctctttgatgctttgtttatatttattagagcagcaattgggtttacacatatctccttcatcaaaatataacctatttgagggtatttgttattgtcctcagggtgaagcctgacacatgggcactacttagtatgtatttcttgaatttattcaatcaaaacatttattgagctcctataaagtaccaagtactgttgggctttgagtaaacagtagtaaagagcaaaaaacagacacagatcctgccctcatagagcttacagtttagggagtgagatgctttgccagattgcaacttgccatgctcctgaataaatgaatgagcacctgggccttggtttagaatgggaaatctttttgtctctttgactagcagtggtggtggaatattatgatccctagagtactgggaattttgtatttggaagctgacccaggtcatttggtgacattaaagagaagggtaggctagccattgtggtttcatgcctgtaatcccagcactttgggagctcatagcaggtagatcacttgagcccaggagtttgagaccagcctgggcagcatgacaaaacccccaaaattagatgggcatggtggcatgcacctgtggtcccagctacttgggaggctgagatgggaggatctcttgaacccagaaggtccaagctgcaatgagccatgaccgcgccactgcactctagcctgggtgccagagtgagaccctgtcccactgcccactgcctcccccccgcaaaaaagagagagaagcgtgactgtcagcagggttcccaggcttctttcatcaaatctgagataccattgatcatgaagcaacaatgcagcttataaccactaagaaagaaaattcaccaattaaactgacttgccatcaattataaaacaccttgatttcagagatgaaaagtgaactaaaatgtacaccttggaatagataacatacaataatttaaaggttaattacaagcaaattgagtcaaggaaatacttggacgctaaaagcaaggctaaaaatagtacatcatgaccattgattccatggatgatatggtaatgaatcactttttgaagcagagtcagatgttcatgccagcttgaaaaaatatgcagctgatgcaaggaggtaagagttaagaatacagattatacctacagcagcctatgctattaaggaaaaaacaactatttgccaagcagccatctttgtagatattggcagatagaggagtcccccccgtgtctgcaggggatatgccacaagatccccagtgaatacttgaaactgtggatagtgctgaaccctatatacctatatgtgctctttttctgatctgataaccaagagagatactaagtgactaaagagtgggtggtgtgtacagcatggatatgctggacaaaggtatgattcacactgagagcaggacagtgcaagatttcatcatgctaattagaatggcgtgcaatttaaaacttatgaattattatgggccaggcacagtggcttacgcctgtaatcccagcactttgggaggctgaggcaggcggatcacctgaggtcaggagtttgagaccagcctggccaacatggtgaaaccccatctctaataaaaaaatacaaaaattaacagggcatggtagtgggtgcctgtaatcccagctactcggaaggctgaggcaggagaatcgcttgaacccaggaggtggaggttgcagtgagccaagattgcaccattgcattccagcctgggcaacaaaagcggaactccatctcaaaaaaacaaaaaacaaaataaaaaaaaactgtgtagggtgggtattattttttgtggttttctaggctaagaaatggtattcttgaaagttcaaaggcttgagtgaagggccttaggccagcaaccagttgagttggcactcaagtgcaggtcttctaactgcatcccaggctcttccagtgaaccctgctttcatactgctagcagtagcatcttggaatcttaagtgtagtaatcttaagaatgatgttttgggccgggagcagtggctcatgcctgtaatcctagcactttgggaggtcaaggcaggcggatcacctgaggtcaggagttcgagaccagcctggccaacgtggcaaaaccctgtctctactaaaaatacaaaacttagctgggtgtggtggtgggtgcctgtaatcccagctacttgggaggctgaggcaagagaatctcttgaacctggcaggcagaggttgcagtgagctgagatcacactactgcactccagtctgggtgacagagtgagactctgtctcaaaaaaaaaaaagaagaagaagaagaagaggaatattttgcctttttctcccctcaaaaaacaaaattcaggtacttctgttgaccttttgtttaccaagtgcagaaaaatcaacgttgttatatgaaaatttcttcaagagtggtttgtacaagagtctacaattcctggaccaactgtagaacccagagctttcaaaaggatggagcctattcacgtcctatcaatagaacagattcacgcagcataaggtttttatttattgcaagtggttgttctagttaaagaggctataatgaaaaaaatataataaccttggcttaaaataaagaaatgcttggtttgagatagaatcctgatgagctatgattaattttttggaaaatgggtctcttcatatgagattaaaattgtcatgaatatttttccaagggcaacataaaaaaggaaatagaccattatttgtgtggcatctctgctcattgtaattaaatgggcctttataaatggagtcagatcaattattcccttctggtacacaatcaccttttccaaagtcatgtaaggcaggctttctttgttgggggatgtctcaccccaagggatagtagggatgtaaggatacggtaaggcctaggagttgtgggggaaagaagacaggaaaagaagggaagtggagagaaattggttagggtactttgtttttcttttccccttaaaattagagaaagtacaaaagacttgtcttgcatcttttaaatctctaaatactgtaaaacataattttagtgaaaatggagaggttttttaaaaaacgtgcgagacatttttatggttacaaactgaattttatgaatttatttttaagatgctaaaattggtacgcattgaatatagtgctgtttctctaagagtctcctctccccaactcattatcttttccaagactggaataagggagattggtacatgactaaaatatcctcaaccttcatatatgtgcccctgagccaagcttagagtactttattcatgagatgggatggtttctaaggtttcttataactctaaaatgtttgaatttatatgagaatgatagtccagacccgtgtatgacagatggaggaactgaattgtctctcaatgtaaccttttttttttttttttttttttgagagctggagtcttgctatgttgtcctggctggtctcaaactgcagggctcaagtgatcctcttgcttcagcctccagagtaggtggtactacaggcgtgcaccaccacaccccactctagcttatattttaatatgcctaatgttctgtcttatacatacatttcttaccagcatgtaagaaatgtaatttctatagggaggaattcaagaagtattgagaagatgattttaataaatcagctgtgttggcctagctttatttactcatttaacaaacattgagcagaatgacctctgctttatgccagacatggtgctagctgcagggaatacaaatatgacaaataatgctccctgtttaagaaacagactctttgcttaatatattaagtgcctcgtagggttatatagaaggtttctaggagcacagcagagagtggaagtagctttaccttggaggaaataggaatagtgaaaaatatgtccacggatgcagtaacatgacttgaatcttaaagaatgttataataatgttataatatggaaaaagtgaggaagggtgatatgacagaaatttcataatggatagtacctaaaacttacaggggaaggcaggctgtttatttggagcagatgtggggacaaaggagagtcaacatatatattttggttttattaatagaaaaaacacaaataacacacaagtttatgtaaattagacttcttttgtaacattctcagacttaatatccccagccacctaggggaaaaacttgaggaaagtccttctaaaatctataaaattatttttatagaaagagaaatttaaaaggaaatgccaatttgttgagcaaaatgaaaatgatgatggccagagctggaagtatggtaaacataaagccattctgaatatatttatcacctttcttggcttgtacctaaaaatgtgtgagttttaatattgagaggtgtttcagcagcatcttgagactatttgagggttcagttccttttctgtcaattccagacttgaccttgaatgaattctgaatactctgtgtcgtaaacagcagtgtgactgtaggagtggtgcatgtgctcttgcaggtgatggaatggcttgaggccagtgaggatattcattattctatagcactatcgttataaataatatttgctttctgcttttccacaattgtagttatctggttttcaatggagcagtagatagaaagggagtgaatagtatcagtgtagcttagcttcattctccactttttatgccagagttgcatttctgcctccatttctagttagttgactgcctcgagcagttcataccagtttttttcttcttggtgtttggtcttagccactaggctgagaggcagttggccaagaccatctgataattattttcatctgaaaataaagttgggatgggtcatgactatatgtaaccacaactgtaagtagtgggatgctagctcatacaatttcagataccgactgatttgtcaataggcatcaatagtattgagtatctgtatatatcatggaattctttaagtctttaagaatttacaaccacaagattttactgtgagatatttaaacaaaacatttgaataaatggagagcccggagggaatgccacattgtcattctttaattgaaatgtttaatgtaatcccaatcaaaactgagactaaacaggtgaggataagcaataagtttttaaaaaagaagaacaaagtagacttgcactactagaaatgttgaaacccattttagatgtagcataactaaaactagggcattgtgaaagaacagaaaaataagataataaacagactatacttctggaatcagaatcttgtaggtacaagctgtccaatcactttaaacattcaccgggatcagccattggatgaggatgctacggaaagagcgtgatcttggacaaggcaactctgcagctgaggctgacacccaaaagctgtctgctggtgatactcccacaattagggcaacatgagtttcactgaaggggtaattgtgtggctcatatcatattcattgcaacctccaaatccaattgtttgtgcatctttatcctacacacttgtgggatattgattttaacttatttcaactcctactctggaaaaaagagagaggctgtgtcatttcttagacctttgtaatgaggcaaggatcagagtcccagaagaagtactactccaaaaactttggtaaagtgcttattcttccctagcagtaggctgttgctgagttgtagactggtggttttatgaaaaaaaacaggttggggaggtgtgaagatggaaatgagggctgtgttatgtatatctggtatctacttctgttccaggtgcttaattcaccctcatactgatgtttaaagttagaggattcttgtccatttgtcttgtcttctgttggcagggtcacatgcagggtaataggctatgggaagggggaagatgcctagatttacttctaggctggtctccaagccccaagttcaagcctcctgagtagctgagactacaggcacacaccatcgttctcaacttttcttttttaacataggctagctagctcccaccttagccttctagacccctccattataattcttattcaattgccttggcccagaaagagacagttcctgtcctattcttatatatgcacatctatttttgattcacagaactcgatggtggaggtggaggcagttgatggaattctgaaagtccacccaaccatgtccctggtcaatagcatgcatgtaccatattccttggaaaggaaacgtggtgggagtctgctggattcttctggggaaattttctctctataaaagggacatatcacagagacatacaatctctgcctccgaacattgttgtctgcatgcgatgcatggaatggcaatggccctccaggaaaggagccagcctaagggaaaagagaggagggtgggaaaatcccagatcatttgtgccattgttgagcaactgaacaaaacagaaccaagtccttgtcttcttgaagcttaatttgagtcaagacatatagacaagcatgtacattattaaaatacactacctagtgtattagaaggtggtaagtacaatgggataaaataaagcagggaagggcatgaggagtgctgggggggatggttgcatttattaaagggtgggcaaggcaggcttctctgagaaggtaacatttgctcaaggacccaccagagacaagggatgtggaagagcattccaaacatagggaatggtaagtttaagtcccgagtgtacgtggacaacattctgtatctaaacaactgctaggatcccctatggctagaactgaggagcaacggggagagtagttggaggtgagttcagccaataaactcacaccgtttattaggctgttgccacagccttttggctcttactctgagtgagagggaaatctctggaggtttgtgaagaggtgggtatcatggtctgacctacgttaaataggaaaagccgggaacgatggtgtgtgcctatagtcccagctactaaggaggcttaagcccaggcttgagaccccatctcttaaaagaaaaaaaaaaatggaaaggctcacaatagaggcagtgaagaaaagttgttttttaaaaaaggcagtggtcactgtattagtacatgattctgggaaatctaggtatgagttcagaaattttaattaacctgaaaaacttgtaccagaagccatttgcttatgctaatgtgaatacaaagagcttgctttggttcattactaaataacattcttcgtgaaagtgtcattgaatctttttagcaacatatctatacaaaactctacaatgtaagtatgtacattcagcaaatcctgtgagatgcagaagagtgaatttggttcaggagttgtgagttggcttttattggtagaaaatttcctgaatgtcaatacctaatactagtatggaaaaataatttgcttttcaaaataaatagataaatttaccttatgttattcttgaatgaagtttttcatttaatcaaaggtatttttaagcttttgttttggggctttttttttcccttgtggatctgtggctataataaagtcagcattctttatttactggtgataaattctgtgaaatgttaaagtagacatgttggaccagctattgtgaaattacagctctgtctctaacttcccattacatgagcacacctataactcatttatattagcacagtaagtatacctttaacaccaaataaggtattttctaggtcaattcttcttttcagtttattcatggatttctacctagggtcagtacttttcattaagtctaactaagaatcagatctctcatgaaccaactctttagttttagacagaaatccttttaggtcaagaatacatacctcctacgaggattaatcctgcatgctctgtgatgagctgacattgactttgactaaagaaagatttatttttggaagcaggattttaaaattagttcttttgaattctcagcaagttctaaagaataagcattcctagctcactggacttgactaagtaagctgagtggagatggttgaggagagaaagagaatctagcctttatggactgccgtctgcgtaccataggtatcatgtgagcctcacatcatcatttgggtaaaattatcttcattttcaccaaaggatggtgaggctcaaagaggatgtgtgacttgcttaaagtcattttgcaaatatatgtggaaatgaaattgatgctcatgtctgtgtgacctcagagcctgtgctatctcttcacaggggctgtctattgaaggcaaaagtaaatactgtacattaactcagatgagttttgttcctccagggtctcatttctgaagctattattttcatcagcactgtttggaccttaatagacttgtgtaaagtagaatactgagttgtttctcatgttactttattcctttattactgtgcattttgtgtggattttaaaatgtagtgattattaactattaaccaagctcccaaattataagatcccattcattttatttccattgtgataagatagactttttgttttaatgtgtcacactttaaaatattttacaacatgaagacttcttcctgaagttacaaagcaccaatttacaattaaaatcacaaagccagtgatatttaaagagtatataactttatgatatgaatcatgttttattatttgtacctaagggtctaaaagtagttttcattattgatttacaaaagaagaactgattaaggaacattcagccagctctctgtgacgacattagaatttttattgcagaactaatgtgttgactctatatcatctcttagatggtctcatgattgcttaaaattatcctggtgtaaattttgtatcaaattgggtggggagaaacgtctgaaaggataatgctatcaaatgccttaatcttcactgccatgtactaattttccctgtctctccccgtttgtgttttctttttccctagaagaaaaattcaaagtggagacaagaaccattgctgttgactttgcatcagaagatatttatgataaaattaaaacaggcttggctggtcttgaaatcggcatcttaggtttgtatttttgccacatttataggttcttcttgtatttattatttgactttatgactttggatgttaagtggtaaaatgactagtgagaaaattgtcttatgattacgtaagacattatcagtgaataatatcactaggtgacattaatatatacatttgaatctgtgtttttagttctatattaacaacatacaattttggttattttccttgttatttctcttattctctgtgtatatttagatatacagttgtccctgggtatctatgggtataggttccaggacctcttcatatgctcaagttcctgatataaaatgccttagtatttgcgtatagcttatgcgcatccttctgtatactttaaatcatctctagattacttatagtacctaaaacaatgcctacacatcacttcatttgtgcagatttaatgtgtagacacactggtaaactcaagttttggtttttggaactttgtgtaatttatccccctgatatttttgatttgtctcttttctccccagtatttttgacccgtcactggttgaatccatgaatgtggagctcacagataataggactgatggtagttatattgtaataatcctttaaagtggatggtgctgactcatttacatacagttgaggaaatgaaggcttagaataatttattcagccttttgttcactattaccccccgagaagactttagagatttttcctaatctaactctcatgaaattttaataccacaaatacactgtatagatccgattatgtactatatgtatatctctgctttataaaaaaaaatacaaataagattcccaccccaccctgaccaaatttcatctactctgtggagctctgccccagttgaaaatggattgtttagaagggcacataaagattgagtggttcagctggggttcagtcttgtatttttttttctaagtcttataccccttttgttacatctcagctaccttgctcttattaccagaaacagatacttttattgggataatcagaatattgaactttgttatggaaacaattcagaaaattgtataggaaaaaaaatgggctttgttaactttcccaccgctctttgagagtcgtttctagaaagaaacagggcatctagttccaaaaaaaactaaacttcctcattaaatctgtttatcccactgccaaaattggtgggaaccaactaattgtcattgtttgtttagttgggctataaaagttggataaattaagataatttttaaaaacattttctaacatttctttagtcgtaaagaccccacttccctttctcatcctataaaagaatggtcttttacatgatttccataatagataagacagttgttaaaaatcagttaaacaagtatagccctgcatagtactgttgcacctggctttcacatgctatcctttcccagctcctgcctggtccatatcacacatcaccatgccccatataccgacaccactactccctcacttataggaagaccaataggtaaaaatgaatgcaaacacaggtctggtttttgcctttgtgtttgcatgttcttaaatatatgtattgctgggagtccttcacagtttcctcttccttagcctagatctgaaacacataaagcaccactgacatctataaaaaaatcttgacttccttcacctagatctggaatacataagtcaccactgacatctgtaaaaatccaaatcagcaatcataacttacagttagtatggaagctgtcatggttcatcttaacctcctttcaaactagagatggactaggggataaaggctagcttaggctggaagggagattgagaatccctaatgaaaaaagactgagggagaaaatcttactgcttctcttgagcttgtgctcttagagaatgacttactttcagaaatagttaaattcatcacagttgtgtttagttttgcataaactttagttgcttttcatggaaactatagatgctctgggactatggcattggcattggaaaatgttgggcatcatgttgctgcagggctggaggattgtacaaggcactctttagctgttctttcctgccccctatatggaaaggcttcaatatgattttaggcgtgacagatctgttaaggataagcatacaggacacatgttctctaaatactttttccccatttctagaatcctagcacttgtatcaatacataaatactgatatttggacataaggactgatattttcccaggcctcatacactaatgaaccattgttttgatagcctagttccttagtaagttgctgagttaacaatttgtgcccctcctcattcattcattcattcattcatcaatcagtgaactagagatacaacaatgaacaagaaagctgtactgggccgggcgtggtggctcacacctgtaatctgagcactttgggaggccaaggcgagaggatcacctgaggtcaggagtttgagaccagcctggctaacatgacgaaaccccatctctactaaaaatacaaaaattagctgggcagggtggcacacacctgtagtcccagctactcaggaggctgaggcaggagaatcgcttgaacctgggagacagaggttgcagtgagccgagattgcaccattacactccagcctgggtgacaaagtgagactctgtctcaaaaagaaaaaaaaaagagctatactgcattatttatgtagtataatgttctaataggaaatataacatgaaacaaaataattatctgtgggataagtgttttgagtagggaaggacagggtgtaatatgagtatgtgggggacaggggagttgatacagggagaaataatggtaacttgtcctagccagtggggtaggaaaaaggaggattccagaaacatttataaatgaagtagacgaagcaagactttgtaagagattccaagtgggaagacagagaagagagaatttatggatgactttcaggttgtggcttgaacatctgcattaacactgcatttgctgaaatggagaatccttgaggaggagccttttggggagtgaagatcatttaaaactagaaatctggggctcctctaagatgtctaagttgacttgtttagttgatagttggagatatatatatatatatatatatatatatatatatatgtatatgtatgtatgtatatgtgtatatatatctagatttcagtagagctctgtcctacagatatagtttggagattagtcatctatgagtagtaattgcactgaagcagtgggcctggagatcatccaaggagaatagagagaatgtaaagagaaaactgaagaaagagctcttttgagttcccttccttcttgtcaaaggctgcctggaatagatagcatgaagtgggggatagttttctgcatgaactcagtactgttcaatagaaatgtaacacaagccacagtaattttagcttttctaatagccacattttttaaagtaaaaagaaacagatgaagttaattttttttttttaatttttattttttgagacagagtctcactctgtcacccaggctggagtgcagtggcgcgatctctgctcactgcaagctccatctcccaggttcacaccattctcctgcgtcagcctcctgagtagctgggactacaggtggctgccaccatgcctggctaattttttgtattttttagtagagatggggtttcaccgtgttagccagggtggtctcgatctcctgacctcatgatctgcccgcctcggcctcccaaagtgctgggattacaggagtgagccaccacgcccagcccagatgaagttaattttaatgtattttattttagcctagtatatctaaaatactattaatatttcaatatataatcaatacaaaaaaatttaaaaatattttgcatacttttttaatactaagtcttagaaatctagtatatattttccacttaatagcatatctcaattcagactagccacactttcagtgcttagtagctacatgtggccagtggttactgtatttgacatctcaactctagttcaccttggccatctctcaacctcagtttgtatgagggaattatgagtataatttattgatttgtcttagcttttaagcagtggttctcaaccaaggacaattttgcagtgtatggcaatgttctgaaacatttctgattgtccttcttggctaggggagggtagttctactgtcccctagtgggtaaagctcaaggatgctactaaacattctataatgtgtataggacagccttccacagcaaagaatgatccatccaaaatgtcagtagtgctgaggttgataaaccctgctttaaaattatgctgtccttaaacagttcagatactcacacaactttgattttgatttctagttggttgcaaatcaataataaaaatcattatagctaatgtttacataatcctttaaagtgtatagctgaacttttgcatacattatctcattagctgagctgtaagtttagttttcttcctactctaccacaaatgtctccttaatcataagatttatgtaattattattgacatttattagcacatattttacacatggattgtaattttaatttctcaagattttcgatggaactattaaaatacttctgtgagttaaattttattactaggtcatatttcaactccattcttatggttccttcactagtatgggtataaccctctagaacttgttgtggggaggtctgatgtgtatatgttttctttctcttatgattacctgaatttatagccccatcaactttcttctctcccgcatccccatccagatcccacatactctcacctctgtctagtaagggcaaaataatttagtctctttcctctgcttatgcaattctcacttttataacattctctaaaatattctatgtatagactgatttctagtaagacctaggaatccatattaagtcataggaaggaatttttttctaccaagttttaatgaaactagtaaggataataagaaaaataaatcaccagggtacaccccatttgtttgaagtgttaagcaccaaacagtcagtgcttaataaagaaaattaatattttcagaattacaaaggaaaatgctaaagcccttagtcatgaaagaaacattaagttttcagtaagataagtggaaaggaaacagccatgaattgtgagaatttatcctgaaaggtcaccataacttgatgagactataaatgcttaaggttgagaagttggattcttaactccgttacttaaaaaaaaactaagcatctactgtcttctttcaggcaaatgccaagaaatacagatttcagaaagcttataaaactttggctatttagagaaaatgacatccttactgctttgagtaagcaaacaattggttaacaaagtgtgattaccgtaatgcttacttgattccttaggagagactctcatgtgtgctccagattggtttggaggactttgcacaatacaactcagggaggcgtaatttaccaaggccaaaagagtaggcttggcttttaagtatgccacagacaatacttttttcaaattctactactatgacttttttaactttgtgagattctgtattatagaaggagaaagaaaggtcctcttggaaaaatatacttagtttgtgattcatttaaaaaatcaaccatagctttatttaagcttttattgcattctagacaagaatttccccatgccagatgctctcaaggccttctctgtccatagtgttgatggcgtatacaagttgtagcatcctcagctggtacaaggtgacctgtgttgccctactggcttagtgcattcaggactttagtcatccatcgactttcttgattctttccatacgcattgctaataattttaagaagcctcattttaacaacaacaaaatgtgtagataatagaggtcagttgattgcaaagaatcactgattgccaaagctggaatagaacttattattctcttttcttcctgtgccctttataagtgaacacttgctccactaatgttcttggtgaattattttttaattggtgtccttcctttttcagctgaatgcaaactctttgttatccttgcctgtgccaccactttcctcattaaaccttatggatttggggaagcaattgtgttgcatttttctcccgaaaacctagtgtttcccagaaggttctaggatagagaatagttgaatataaatattttatttactaaactaaaagatagtttgagcaaagatacccatcagagttaagatcagagtaactctgtctctgtgtatacttacattttcaaagtttcttaacaaaagacccaagagtattattagctacttggggaaaggactagttagcttccaaatggcaaactcctagttaattggtttgggatccagagatggcttccttataattcagtccccagagaagcaaaggaagagcaatagatgtaggcctaggagagagaaccaaggcactacaggaacagtgctgaggaaaacttttctaggattgcttggaaggaaggaaaatggagcatactaggagtttatgcagcttcctggtccctgttgattaaggaagtcacaaataaaagagtcttatttcttcagaggctttagaaatacataatgctacagattctcttcttgctgttctcaatgttataaatagttttaagttgctctcatttgaagtgtaaatacctctaaagggctaatggcacctgttatttaattcttattggaactagtatattcagtttattccttgtctacttcttgctgggtcagttggctattttagttagtgaaagacatggaaaagtcattttaaaatggagaacaatagtcttaaaaaaggaaactatgtggtaggttgataatcagtggggtgcagagatggagacacgcagaaggacaaaataaaattatgttgagagagcaccaaaggtaaacttaatgtagttagaattattatcccctactcccgctttttctctgtagcccagtatatgaggatcaggcttaaggaagagcagaggctattattctaggtatataggaaagggttataagaggatcatgggatgattgtttgggaaaagggcaggatataacttttgtgctttctaagggtataaaacacttccaaaacttcccttttgtaatactgcaatcacattttgttgctaaccacccagagttactgcagactccacaggttcaggaacacagccccccaaaaaactgccctcagttcacatgctagctgcaagtttggagatcttcagaccatctacacttttgactaactggctacaaattcttgggttcgtatgacaccctcgggttcaataattagctagagcgattcatggaactcagaaaagcactatactcatgatcttgtagttttattatgatggataaaagtcaggattagtcaaatgaagagaaaccatagggcaaggtctgcggggagtccccaacacagaggttctaagccctgtcctggtggagtcaggacaccttaccttccaggcgcatccttgtgttcatccacaaggaagctctaccgggcttcagtttccagagtttttattgggggtttcattacccaagtaggcatgattgatggaatcattggccatgtggtttaacttgatctccaatcctcctctcttttctttaggttgggctggcttaaagccccagccctctagtcacagagttggtctttctggtgtccaaccccatcctgggtcatcttgattccactactgagtatatatcaaaaacgaagaaactcaatatattgaagagatatctgcactctatgtttattgcagcactattcacagtagccaaaatatggaatcagcctaacagtctatcagcagatgaatggataaagaaaatatagtataggtacacaatagaatattattcagccattaaaaaaaaaacctggaaatcttgtcatttgcagcaatatggatggaactggaggttattatgttaactgaaataaaccaagcccagaaaggcaaatatcacatgttctcactcatatgtgtgagcttaaaaagtagatctcatgaagatagagagtagattggtggttaccaaaggctaggaatggtgggatgggaataaagagaggtttattaatgggtacaaatgtatacttagatggaagaaataagagctgggttagatcatttggatgactataatcaattgtatatttcaaaatagctagaagagaataattcaaatgttcctagcgaaagaaaagataaagatttaaggttataagtatcccagttaccctgatttgattatatgaatgtaccaaattatcacgtgtaccctgaaaacttgtacatttaatatgtatcagttttaaaaataaaaacacagatgtgatccaagggcctgccatgaataagaaagacactgttatcaggaaattccagtggtttaaaacctccatcctattaacaaagatcagacaaaatgttaactgtacagtaccttttctttccttttttttgattgattcattcaatcaaccgtatactaattcattaaacaagtaaaattccagagctataacagtagacaaaacagacactgtttctgcttttctggaagatagccatcgaacaagtagtgggaacgtgttgcatgtaatgaaggagaatgttactgggaaagctaagggtgtcacagatagtatccctgagaaagtcatttaagtggaaacctgaaggctgaataatactgggagaatagacatgggaagggtttccaggtggaggaaacggcatgtacaaaaggcctgatgtgaatattcttagtgtgtcagtagaactgacaaaagccctgtgaatctggagcaagggtttcaaaggggacagtaacaaaagatgattctggagattaagcagacccagatcatgaaagtctgagaaaaccaagacaataagtttagacttcattggaagtacaatgggaaaccattttagaattgtaagcgtgacttgacaacatattagaattttagagagatctttctgactcccacatagaataagacaagaattgataggaggaggccagtaagactatttcagaagtgagacataagatgatgaatgtttacattaggaggatagcagaagtgaactgacaaagagaggtgtttaggaaatagaaataggaccaatttctgatgagggtcctcatcggaggtcttgagtaaagaagaagaagaatggttttgtgttttttaagtcattattgccgacatgcattgagcactctttcatgccagccaccatgctaatgaatttcatttaatcctctacaaccctataaggtagatattgatatttctatgcccattttacagacaagaaacagttacagagttagacatcatccagaattagacgactagcagttagcaacttccaggttctgacatgagcaacagggtaccatttccccaagacaagaaaccctggatcaggagcaaagtctgttgagaaaaatgatgatttcactttgggatatgttaagcttaagagggtggtgagaaagccatgtaggaattcaagtagttgggtcgctgggcacacatgcccttccttgctagaagggaaccttctttgtgttaaatgttgaagaagcctggtgtagacaatcatggcaaagagaataggtgcatggattttttttttttttttaatgtgctaggagactcatcaggaacattatcagactaagtatagtgccttgtagttccattaggtatgttggctgagattggatttgtaaagtgagcataggacttctagaattcatatttatttctgtttacttgaaaaccactcactaatggtattaattaaagcagaaccttttacttaaaactgggtaattagctctgttatttcagaaatgtaaatagaactgtaagtcatgaaattggtgaatgttcttcccaccagctaacatttaactaccaacctcatgtcatctttcttcattccctcttccaattttatgtatagcaaatcttacctagttttgtaatgaagatcacatagcaatttataattaaacagtggaagtgaaatgttctgttgtgttgcttctgattcagtcttaatttttcaatttctgattaaagcactgcaaatttaaagtcttgtaaactctcttttatttggaaattgctactcacaaatgtatgaaaactgtaaagtttgcaaaatgttttacatggtgttccaaatatcatctgtcagagtatgaacatgtgctagctaaagcaatatgttaaataaggcaaagatggaatttactttgcatcactttccaaactctctctataggctgtaagagtggatctaattgaatgaaataaagagggtagaggagcaattaggagaaatttaatcagtataaatagcagcagctctggttaatggatgtccagagtccactctctcagaaggatctctccactttgattctggtcatacgtaataaaagtagggtactttgggcttgggcacaaaacaggagtttgataaatttttgttgaataaatgaccatacaacaataacaactcttcctcttccatttattaacatattactacgtcccaggcattgggttaaagattttatgtatatgatctcatttaattcttaaattactatccccattttatgtcaaaggacaatgaggcaatcactagtttcttgttaggagctggtagtagtggagctgggactgaaacctggttctgttaggactctggggtctgtattcttttagctcaaaaatttaagacaggaagtttcccccacttttggtatatacactgttactaaagtatacattttaaaaattcagtttattttgaaatatagtgaggtagcagcattttttaaaatctccttttattggccaggcgtgatggctcacacctgtaatcccagcactttgggaggccaaggcaggcggatcacctgaggtcaggagttcaagaccagcctgaccaacatggagaaaccccgtctctactaaaactacaaaaaattagccggtcgtggtggcgcatgcctgtaatcccagctactcagtaggctgaggcaggagaatcgcttgaacccaggagacggattgcagtgagctgagatcgagccattgcactccagcctgggcaacatgagcgaaattctgtctcaaaataagtaaataaataagcaaataaataaataagatgtctttttattaactctaagtgctggaactggattagcatttataaccacaaatgttagtgaaatataaactttttctcctttgatacaatgagaaggaaacaggaggggttactttgcattatttgatgtatgtcgggaagcccggccattaggcaacatatttttaaaccaccttaatttcctatatctctgattaatctggaaaaagaaacaggttgaaggtgatctgtagggggttacccgtatctgttagaattgtttgttcaaatggatttttaatttctagtaatttattgttgtttgctcctctctcacgcctaacccagataccaaaaatctaattttctgatgacatcattatatctctatagcagctggctttgagagaggattctaagttcagtgagatcagcagcaaacgaacttagaagaaacagaaatcttgtaaatattctttttttaagagcataaaatttggaaatgattttaaagcagtataatttagaaattatatatatatatatatatatatatatatatatataaaattcagaattattccgtggattttctgtgtctttaaaatgcaacacataatgatattagtgttttctgaggttctggatgggggccgaggagagcgtagctaagcatggcctatgtcagttcttctctgcaaggatcaactcttaagaggatggctcctctgccctccaccaccttttctttccacttcctttggcattattcttggtctgttttcacctctgttctctgcctgcctcatctcttttattgagcgcttcccagtcttagacctctagtcagaaaccaatgggaaagattttgttactgtccagcaccctacagtgactgggatggtggtgggaattccatgatgacatagatatctgttgtttcctgagagacatcatgtgttgttacacaataaaaaggtttttcactgaaaaaaatgtttaaatctgtctctagtgcctcacttcaagaattcaagaaaactcactaataaacatgtttaatgctaatttaagatgcgaccatttagaagggatcttcaactatctgaataatgttggagcaacatgtgccattgtttggtttggcgaatcctataatgaatcctgtaatatgtaaagatggcattgcgtgcacccattcttaatgagattatattataatgggagtatttccatccttcactcctactcaaagcctgttctttctcttccttttgcaattccctgaaagctttctgcctgctgttaggttattgctgccacctgacgtctcaaaataaaattgccgtgggtttgcttttccaaaagattcgcactattctgcattttatggaaataactatttgagagcaacagttttttctctatactcctaaataagagcattctgaagtgattacttatggtggggagattatgggtatcattcattccacaagcaaaaggtggaactaatagtacaggagggaatgtaggagtcctaatccctagaataggacaaatcgccattgtgaccttggtgtgtacttcacctcataaaattggactcagtgctcttaacagccttattccagctttaacattgttttattgtgtgtacttttatttatgaaaacatagcccttctccgtgatactatttacttttttggactaaagttctcagtgttgaacaggttttctctcttttttttaacagatacataatatttctacatatttataggatacatgtgatattttattacatgcataggatgtgtaatgatcatgtcagggtggctgaagtatctgtcactttgagtatcatttctatgtgttgggaacattaaaagacctctcttctagccattttgaaatatacaatacattgttgttaactatagtcaccctactctgctattgaacattagaacttattccttctatctaactatatgtacccactaaccatcctctcttcatccctcacccacccacacacacctgccccaccttctggtatctattattctactctctacctccatgagaccaacttttttagctcctacatatgaatgagaacatgcaatatttgtctttctgtgcctggcttatctcacttaacacagtgacctccagttccatccatgttgctataaattacaggattttattcttttcatggccaaatagtattttattgtgtatatatactaaatttttctttatctatttatttgttgatggacacttaagtcaattccttatctttgctattgtgaatgatgctgcaataaacacgggggtgcaggtatctatttgatatactgatttattttcctttggataaatactagtagtgggattgttggatcatgtgatagttctatttttaatattttgagaaacctccatactgttttccacagtggctatactaatttacattcccaccaacagtggataagaattctgctttctctgcgtccttgccagcatctgttattttttggctttttaataacagctactctaactggggtaagatgatatctcattgtcattttgattcagatttctgtgatgattggtgatgagcattttttcatttatctgctggccatttgtatgtcttcttttgagaaatatctatccatatcctcagcccactttttaataagttttcttgttttttaaactattcagttgtttgagttctttgtatattctagatattagtctcttgtcagatggatagtttgcaaatatattcttccattcaacaggtagtctcttcactctgttgattatttcctttgctgtgcagatgctttttggttgaatatgttttcttatagagctatgttaaatagatgttcacattttcattgtgtgaataaatagctttgatagctttcctttgctcaattatcagagacacagctgaagactctctattgtttgtttttgtttttgtttgagacagagtctccctctgtcacccatgctggagtgcagtggcgtgatctcggctcactgcaaccttcgcctcctgggttcaagcaattctcctacctcagcctcccgagtagctgggactacaggcacgtgccatcgtgcctggctaattttttgtatttttagtagagatggggtttcaccgtgttagccaggatgatctagatctcctgacctcgtgatccgcctgcctcagtctcccaaagtgctgggattacaggcgtgagccaccacgcctggcaactctctattgttaatacagtcataaccagaataacacttctctgcttgcttagttattcagggacttcctttgcttaactttgtacttatagtacatgtaaagattacaaagtcaactgtgctgcttgcaaagttcctagattttttttaaaaaaaatgaaatctggattttaaaagatttataattacactgttcaattttcctttgcattttgaaatatagcattaatattcccataggctagagggaaatctgaagaaagttttcttgatatgaagagtgaagggagatagttcactgtacttcatgaaattttttttaattctgatgaatattacaacttggcaaagcctttcctggaagattctgttatcttaaactgatataaagaatattttgtttatgtgcaatattttaacagatattttgggttttgctgtttcttttagtcatattctaaattattcatcctttgtaattctgtaggtggttaaagcaaagtcaagtgaacataaagccttaccttcaactagttttggcctaattgtttacagatcttttatagaattgactcttgggatgcctggtgggtggagaacctattgaataaaataaaaatggatctggacctgctgttattaattatgtttagatactatccctattcagatgagtatgaatcctaattaaataaagtttgctttgtcattgtcttttgcttacatttcttctgacaggtttcagtggtattgttgtaaaatcttgcaacttacagcctcaagtgattggcttataattaaatataaaacccttactgagttcctttgaactattaattttgttagactattgaaaagttattattactaatatcaggtttatatggcataattccttataagctgtagcagactgatcataatgtcatcatcttcttgcaactgaaacttctcttttttaaatacttcataattttattaaacattgttatgagatgtttgtttattattcagttattatgatttttttttttctgagttgaatactggataaaggtgtgtgaaggttttaacatagtggttaaaagcctagtctctgaagtcaaatttcacgagtttgaatcccggcatactttgctctatcaccgggcaatttttttaactgctgtgaacttcagtttcctaatatgtaagaggaaaataataataggaactacctaatagggttgttgtgatgattaagtgtagataggcagatagatagatcatctatctcatgagttatttatttagttaaaataaattctaagatattttattcattgattgattcctgcaaatgttctttgttctgggattgtctttgtctttccagggctggggaaaaccataggatatttgagtattaaaatcttatatctaaatatatataggtttattcatatcttgtcaattgtcttgtagccccaactttaagttaggtgattgggaaggtaagggggtgtggtataaggaaaattaagatatgacctcaacttttgatagatggtttattggagacatttagtctgacccactcccttggccaccagaaagaagccttccctcactttccagttgaagtcaggctctgcaggaaaggctcccatggcactctgttctgtcatgaaataattgtttgtttctttcttttcctactagattgtatgctccgtgataccaacattttttccccactttttaaagttcctagcacatgtcttactcaaaagtgtatggcacatattttttgagttattaaatgagctctcattctggagcggaacaaaatgcgatgcatattgtacatgacttatcccaaatcacatgttttctgaaaactgttataactagaactcaagttttcagtatcctggaccacggtactctccactctttctactgcactatgaaaatttaaggtctggagaagagttaagtaatatctccaaataacagtatgatagaggcagaatatacatatcccaaagggctatggaaagtgagaggcaagtataagttctgtcagttgctggatggtaggtacaggaaggtttaatgaaggaagagacatttaagttggacttttaaggatagattttggacagaaaggtgtggaaaaggttatgctagccataaacagcattttatataattatatatatcatattagtcttgatatctttaatgtcattattttaacaaatctttaaaatatgcatatgttactcagctaatcatcttgttctatttcagtgaacaacgtgggaatgtcgtatgagtatcctgaatactttttggatgttcctgacttggacaatgtaagtctttctttgtgtattatggtaacaaaaataatgcatgcaggtattggtataatgattcacactatgacactggagtccagctgcctgtggttcacacgctggctcttctgtttactacctgagttccctgggtatgggcctagccatacttagtctcagtttccttgctcataaaatgggcagcttcataggggtattagaaagatagaatgagaaaatatttataacctcacttatacagtgccagattcaataatagctctagttttgttattactcttatttttgtttgtgttatatcaaaatagctctgttgtaagttttatgattctaaacatcaacttaaaaattgtaagtatgttaatatacagcaacgtggttgattcaggtaaaccagctctaccaaaatgaaagtgacatccttgatgcatgcataatcctttactgaaaacgagaaaagcatatcattgaaggactatgtaaaattttaaaaattattgaaaatcctaggttcagtaatttctatgctccatactagcagaaaggaaattgcaaagtgttctatttattttagatttaatgtgtctttttacttccagattttacttgcacatacactttggattctgcatgttagcatcaattatcaccttagttaggaaaatataacacggagagtaaaatgaaatctgcctctctaccccaactcttgtcatttttccaaaatctctgcaatatctggggaaatgttcaatgcttctctagattacctaagtagatatctaatagggtcactttcatgatcaagtgtatataaaattctcaatatttttttgcaggtgatcaagaaaatgataaatattaatattctttctgtttgtaaggtaagcatccttgttataaagatgtcatccttttttggttccttctattcaaaaacactgacataatcagcttgttcacctgagtctactcttgtttagatgcagatacatgtattccagatacaagtggtctattaacttatttcttcagaaaacataaagaactgaagaccaagcaggtgcctgtattatttgacttttcatttatttttattttatttaattatttaattttttatttccataggttattggggaacaggtggtgtttggttacatgagtaagttctttagttgtgatttgtgagattttggtgcacccatcactcaagcagtatactctgcacacaatttgtagtcttttatcccttaccctcttccacccttttcctgagtccccgaagtccattgtatcattcttatgcctttgcatcctcgtagcttagttcccacttataagtgagaacacaggatgttggttttccattcctgagttacgtcacttagaataatagtctccagtctcatccaggttgctacaaatgccattaattaattcctttttatgactgagtagtattccatcatatatatctatatctatatctatatctatatctatatctatatctatatctatatctatatctatatatatatatatatatctcgtggttttggtttgcatttccctgatcattagtgatgctgaacattttttcatatgtttgttggccatttgcatattgtcttttgagaattgtctattcatgtccttagtccactttttcatgggattatttgcttttttcttgctaatttgtttgagttcattgtagattctggatattagtcctttgtcagatgcatagattgtgaagattttctcccactctgtgggttgtctgtttactctgctgatgttcctttagccgtgcagaagttctttagtttaatgaatgagtcctagctatttatctttgtttttattgcattcgcttttgggttcttggtcatgaaatccttgcctaagccaatgtttagaagggtttttccaatgatatcttttagaatttttatagtttcaggtcctaaatttaagtccttgatccatcttgagttgatttttgtataaggtgatagatggggatccagtttcattctgctacatgtggcttgccaattatcccagcaccatttgttgaatagggtgtcctttctccactttatgtttttgtttgttttattgaagatcagtgggctgtgtttggctttatttctgggttctctgttctgttcagttggtctacgtgcctatttttataccagtcccatgctgtttggtgactatggcgttatagtgtagtttgaaatcaggtactgtgatgcctccagatttgtcctttttgcttagtctttttttttggctatgtggactttcttttggttccatatgaattttaggattgttttttctagttctgtgaagaatggcggtggtattttgatgggaattgcattgaatttgtagattgcttttggcagtatggtcattttcacaatattgattctacccatccatgatcatgggatgtatttccatttgtttatgtcatctatgattcctttcagcagtgttttttagtttattaaatgctttttgtttattaagtgccttctatatgcaagcactgtggtagctactgggactacaaaaacttaggctggagacttatttttacaaagatttcatccacacgctatttgtcactgataaattgtttccattttgtcttccccatgattcttttcagttgaggaacttaaatgttgtgataagcattgtacggggaatatggaagtataaagcaatgggtgtgatttttaatagttactcataataactagtctggttgctagttgctaagcatgtgttatagtcatgtcacatgtatgtgccaacaaaagacaacaagccaatacctgccaaaaggaggaatacttagcaagtatgagcatctcaacaccattttttcttatattgtattagtaactacaaaaatatactgtactttgattatacataccagagcagtgaaaaataattgcctgaggcagaattctcatgggcagtgtcagatacttgaaatttgaacatactcatagaaagccaaatccattttcagtaactcatatatactagtttaaggaaattcaaagcatgtttaactcaatgtttaactttgttgttattagccaagtttttttctcatataagattcagtttaagtgaggtaaactaattataagtggacctgtgagtgagtctggagcaagactctcatgcacaaaattgatgcatttaaaacatggctaataggaatatatctaatagtcccaagatcattataagggctctcaaaatgttattgttgttcttaaactcagagctgatacagattttaataatatgtggaactatgactttattttttagcaagcaaaggtttttgatcaaaaatatcacttttagtctacaacgtatatattttataatttttgccttttgaaatgaccaacgtgtactattattttgatatatcttttctggtacatttggccaagtgcttgaaaataataagtgttaaaaacaatgtacatgtgtttcataatatcttgtgctgagttaatgataaaatatgtttgttttaattttattttctagaattgttaatactaatttcagattagtcttctgataattttaactcctctgtcagataaactgtgtaagccatttactttagatccattagtattttctcttataacctcctgcttgtctacacttacatgtttgtatactcttatggtgtaaaaccctggcctcttctgtctccatgaacatgccatcccttggctcacagtctgcagaaaactaatgatagaaagccaaggtcctggccttaatctgtgagaatcagtcatcctgctgtgcttcatggtcacagactttatccttcatgcaggatctgagcacagatcagcatattcagtggtcattacggtgagtctctgcttaaagaccaaataggggaaagtatggataaaacagcacaaatcgaagagcaccatgaagtaactttcagtgttttaaatataatgatgaaataaaaatgagatatcatttttaatatcttgacaaattataaaatgcttctcccacctcttcatccttcctcttcttcattcttcattgacattggcatatatacttgttcccatgaaatgagttagtggagacaaatgctaatttattaaacacttgcatgccatattgatggtaagtgtcattggcagaactggatatctacttacaatttttatacataagctttcttttgcaaacctaatcccatttaaaaagcactaagggagtttgctatttaaagcacttcttcatggagccaaataagcatcccttcatttatctttaatatgaatctgaattttcctgtacctttgtgatgtgtacttctaatagaaaaacaaatcaaaactctcaacatgtggaatcaatggatcatggaattaataccatctggaggcttagccaattagtttttgttgtactacatgcagaagcaatgtagttaacattgcttctgatcacagttgactagtgaccattcagatagaaaatggcttgacgggagcagtgggaggtgagtgatgtgcagtggctaaccagcaggtaagaagaggaagttagggcatgactgggcaagaccttgagtgctgtgctcaacaggctagagagctacagaaagccttcaagtagatgtaaggtgtgatctgacctatgttttagaaaggcagttctattggcagagtgacacggtaataggtattttatgatgcatgtgtttttcttacttatactgagagaaaggcattcaccttgacgaaatttgtgtgacgctcccaggtttaggactctttggtgctgctgtgatttgccctataatatatttggatgaattgcacctattgttctttagttgactgtgttacgttgccagggccagggccacattttcagtagcaatggctgtttggagccctggggtaacttaaaagaagatgaaaattggtgcagctacagaatctccaaaggttttattgtggctggacatcaggggaactggggcatggatgtctgcagcctaatgccacaatgaatttctcagaaaaggcctgtataaggaagagagcaacctcttctcaccatcaatgttgggccaagttttatctcctcactaaactacatgacagggaataactggctgagaagtgttccaggagagattggtgaaatcagcttggccttgtgactttgggcttgtgccccctactttggagatgtttgctgagaaggaccccagcatcttattgtaaggcctgtactgtgccatgaacactgaatgacctggctttacattccttcagatccacctatttatgttctggatcagtaggtcagatgattgtaaaaatcacataagttccgtgtttcaatagaggaatgacagaagtgaaatatcctgagaccaaagaaattgtaggtcaccaccagataaaatggtagtgatgtggccagaaaaatattggggaagaaatattaatcagaaagttttggctatagacccatgatgtttaatcataagcagttcttccaggccacttagttctccagtttcatccgatggttttactttttaatcttatccagcattttgagtttattcctttcttccctctcagtggctcacttcaatgggctctccctttacaagggatgtttcaaagccttgttgcctgcttttccagttttactcttaaatccttcaggaataaatttagtcttgctcctgttccctgcctgcatacagttaagtgatatagaaactctatatgtaggtaaccaatatggcaggtagatcagtctcaaactgtaagagaagtcctaccagacagagctttcttctgattgcagatgctctgtgactaaaatctaagatacatcttatttctcatcaagaacaatgacctttatcccagaaacagtggagtttagagacaattgaacctcaagacattgaaccacacttttctaaaaatagttctagttttatacctggagggatttccatcccagaatactgagagagtttgcaaatgaaattattgaactgctattgattgctattagagaaatcatggagaatgggagaagtgccgcgtctccagaggcagacaaatgtaggtttcatttcaaacagggtgtacactgaggttcacatcagtccaaagacagattctaaaacaaatattgctgtgccgtttgtttctgatttgagagcacctgttttaacagctaccaaatttggggttgccttgcttttctgggccagattattcttttttattcgcaattttcagacttcaagagaccctagactcttcactcctttccagataagcactgcccaaacagtattacctgaactgcctgtggtgcctatggaaaggtgggaaaaccattccttcaggtgatactgaatcctaaaactgctgctgcacttagtgaatgaggtggaagctagacaatggccctgcctacagctgaatctcttaggaaatgtccaggccaccattctgacaagtagacaggatgttcttaccttctttattacctttttcttagagcagagaaggaaatggatgggtgtgcggcccaaagtgaaatatattaacagcctccacatattgcaaaatactgttctgttttgttgtttgctttatttgggaatggggaagagcatctcaagcagggggttatatagtaatttctttttacttttttaagtcaacttgagatttaatatttttttattatacttaaagttttagggtacatgtgcacaacttgcaggtttgttacatatgtatacatgtgccatgttggtgtgctgcacccattaactcgtcatttacattaggtatatctcctaatgctatccctccccactttccccaccccacaacaggccctggggtgtgatgttccccttcctgtgtccaagtgttgtcattgttcaattcccacctgtgagtgagaacatgcggtgtttggttttttggccttgcgatagtttgctgagaatgatggtttccaccttcatccatgtccctacacaggacatgaactcatcctttttatggctgcatagtattccatggcgtatatgtgccacattttcttaatccagtctatcattgttggacatttgggttggttccaagtctttgctattgtgaatagtgccacaataaacatacgtgtgcatgtgtctttatagcagcatgatttatactcctttgggtacatacccagtaatgagatggctgggtcaaatggtatttgtagttctagatctctgggaaatcgccacactgacttccacaatggttgaactagtttacagtcccaccaaccgtgtggaagagcatctcaagcaggggattatatattaatttctttttactctttttaagtcaatttgaaatttaatatttttatattaatttaattttttactttttttgggggggtcagtataagacttaaagcaggggcttataatttagttcttccttcatcagacattcaaccaaggtgggggcttgaaaccatttcttattaagggtgggtgtgggtagggcacctttctgaaccctccagagtgtcatgcgcccactgcatgtcttcccttcactgagcatttcatttttagactctttctttctttcttttgtgtgtgtttttctttttttgagacagggtatcactctgtcacccaggatggagtgcagtgacactatcatagctcactgtaacgtcaaactactgggctcaagcgatcctcctgccttagcctcctgagtagttaggactacaggcatgcaccaccatgcctagctaatttttaaattttttatagagatggagtgttgctatgttgctcaggctggactggaattcctggcctcaagcgatcctcctgcctcagcttcccgaagtgctgggattaccagtgtgagtcaccatgtctggactagagtttttcttagattgagtctctctttcagtttagagcctctctacagattgtaagcaccatgagggttggtatcatgtccttttcctttcctgctgaatcctacctgggcctcgcatacgtaaggtgcacaacacattttttttttattctaagaaataataataaatgaatgattttttaaaaacagaaaattctgaactgaaaaaactgaactgaaattttagttcaagttctttgggaataagggtcacactgattgtgtgtggccctagaaggttgaacttgaatcaatcgctatttatactgaagtaaattgtgagaatgtcctaatctttgaatctgccagaagtggaagaggcggaaggtgagtatcctgggtcagaggttgtaaactgttggtctgtgggccagaggtggctgacgaacacattttgattggctcagttttcaaagttaggaaattttacaccgagatttctaacttctcttgggaaaaatctgaaaattgggtaacacagacctgaattactacatggcagcaagtgactagagctgagtagcttccggatatatgcagtaagttaggcctgcagctctctagattgccacagtccccaccagtccctattgtttgacttctctcactcatttacattacctctctgacctttcaggcacttgagtttgggttcttctgttccaggtgactccaagtgttcaatgtactcaaacagaataactgcttggagaaattgaaggactagaatgacatcgactaaattaatctcttctgtcttagtccctctgggctgctctaacaaaataccttagattgggtagtttataaagagcataaacttatttctcagagttctggaggctgggaagtctaagatcagtgccccaccagatttggtgtcgagtgaggaccccattcttcatagatggagccttcttgccatgtcctcatgtggcagaagaggcaaacaagctccctcaggcctcttttataagggcaccaataccacgtgtgagggtggaaccctcatgatgtaatcatttctcaaaggccccaccctcctcttaatgtcaccatattggggattaggtttgaacatacaagttttggaggggtggaggttgggcgcagcggctcacgcctgtaatcccagcattttgggaggctgagatgggtggatcacttgagcccaggagttcaagaccagcctggccaacatagtgaaaccccatctctaccaaaaatacaaaaattagctgggcatggtggcacgtgcctgtaatcccagctactcaggaggctgaggcaggaggatcacttgaacccaggagtttgagaccagcctggccaacatggcgagaccccatctctatcaaaaataaaaaaattagccaggcatggtggctcacacctgtggtcccagctgctcaggaggctgaggcaggaggattgcttgaacccaggaggcagaggttgcagtgggccaagatcgtgccactggactccagcctggctggcagagtgagaccctgtctcaaaaaaaaaaaaaatttggagtggagggacacaaacatttagactatggcatcttccaccccatgattctctgaaatcagagtatgagaccctttgcatgctttttgaaaatctattttttcctttttataccacagtgtattcattgtatgtcacttagccagaagtgtcttatgcgatgccctgcccatggagtagatgataaaagtttagatgaatggacagatgggtgaaaagcacggaaacatttgtttttctcacctggatttgcctctggcatgtgacacaatgccagtagggggagccctctattaatttgaaaatccatgagaacagtctccgttcagcagtctaattgtatttaatttaggaattatgttaagaatgcatccgggcaccctgcttcaagaatttaacaacattaggaatatgataaattatgggaaggagagtaaaaccctcaccactaatccccatccatggcttttctagatgaaggcattccaagttaatagctagtcttttaattcattttgaaattagttatcattatgctcctaaaaaattccaaattattggatacatttagtccttagagtgtcatagtaatggcctgcttcaggcataactacaaaatgatggttttgccaaacggcatgataaccactctgcattgttttcttcttccaaaaatgagagagtagttatagattggtactgatgttgcttttcacctccaaatgaagctaggttataggataaatgccttatatacgagtgaaaatgaaaaatctctgacaactttagaaattattttctcctccccaaacctgtcacttttgagaagttagcttattttggaaaaatttaggtattggaaactcttagcatactatagtatgtgaaacttataaaaactgtgtatgattgtatatgcagtctttttttttctttttttttttttttttttgagacggagtctcactctgtcgccaaggctggagtgcagtggcgtgatctccgctcactgcaagctccgcctcccgggttcacgccattctcctgcctcagcctcccgagtagctggaactacaggcgcccaccaccacgcccggctaatttttttgtatttttagtagagacggagtttcaccgtgttagccaggatggtctcgatctcctgacctcgtgatctgcccgcctcgacctcccaaagagctgggattacaggcatgagccactgtgcccggctggtatatgcattcttttttaaaattttgtttagagtttatgaattatggctttggaatcattattaattggcatggagctctttgttctgaaaagttctttttcttttgataaattaatgtagatcaaaccaaatttattacaaaaggaaaaattttattttgaatgatataggattgaatttaaggttaagtaatatggagctgggaaaatggcaaggcagggctcttaactttcacaaaaacttaacattaataaaaagggaaatcaaataatacttggagatctcaaagcactcttagaaactttgtctaattaagctttccacccactgtgcaataaatattctattagctatacaggtgagattctaagaatttctaattaagttgtgttcttttttaccgcggtgctcaaattacacagtttgccaaaggaaatgtgtgctgtgtcattgtagcatgattttcaatggagttaccatctaatttctccaaaccaggcattgtgtaacactgttgtcactttctgtaattattttcactgttacactgtgattttgaaaaattattgttaatgattacagttgaaaacttgtttaaggtatttgcatctaagaaattgtttacttccaaattgtgtgggtacgtttttagttacttggattcagatcctatttatggtaagcaggtttctttggggtagagggagggcagatgtggacaaagtggctatttgtggtatcctaattctgggtatgaatatcctggattccaggggctttgcctggattctagggtgagttgttatactttattctctccatgtgtattatgataatacaggtgattaaagcatcttgaattttaatgtaatcttttaatttgagcttttgattgtctttttgaacattatgcaatcatgttttctttgtactgttctctctaaaaaatgaccaaatgccaaagattacatgatatgagaataatttgcttatattgtatcatttttcatactaaattaatgagtgggaaaatctacattggctcctgggtataaaataaagttccttctacaaactgttgattactgacgctacaggagtaaaacagaaaaagttttattcatattaggtttcttttagaaataagattgtggaggcttttctaattgtaaaaacaatgcaagattgttgccaaaagtatgagaaatatatacaaacactaagaagaaattaagtcacttttagtcgtaactgcagatggttacattttaatataacattttcaaggattttctaggccagccaatgcatttttgctgaataatctaatcatctaaataatcttaatctaatagtactgattttgattttgtataagcgaaataagcctcttatttatttcccagccagaatatacattgctataccagtaaatactagtaaatattttactcttgacattgaatcaaattctaaatttagctgtcatcaagacattcatttttcctcatatatttgtatactttttggctagcttgcatataaagtgataacaataccttaagtgtgatataacatatatattaaactatcccctttagattctaggcatctaggattttcttgtggtgaggattaatgatactgtcactgaaaatatatatgtatataaagaggaaacactttccctgcaaggacaaggatttcacactctcactgttgtagaagcacaattgtagaaacttttgtctacttctttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaattttttgtatttttagtagagacgaggtttcaccgttttagccgggatggtctcgatctcctgacctcgtgatccgccgcctcggcctcccaaagtgctgggattacaggcgtgagccaccgcgcccggccacttttgtctacttcttaggaaagaattaaaattgttcgctatacacttttggaaacagtcccaatggggaagaaaatgggtctggaaatcatgtttactactacttgtctaatattcttaaccactgaacttgcaagttatggtaacctttttttagaagtgtgttaagaggaacaaaaatttttctggtgcagcaattatcacctgcagatggcctaatattagcattgagttaactccagaaacagcctgtgagctgtgaaatggagttcagatagatagtgacaattcacagaaatgcctggtatattcatataaataaccaaatatcaagataccagctgatgcttacagataactctactaataacttagctaaaaatcctataaaaatttggtgttaaagaaaatttaatttgatctgaatataacgaagcctcttaactaatgcgtagaatattaacgatttgtatatacatactcatataaagaaggcttgaaattcaatttattgtgacttataatctgattagaaggaaagataatttcattatagatgaaggcattaatcaatttgataaaagcatgcagatttcaggttaagttttctcaggcttttcattgttattatttgacagattaaaaaaagatgttacattttatgacaaggacagagaatttagagtcagaatgtaaaaggaggagctcatgagctatgagaaagaaattaacttttgcaggggagaacttgtgtctttgctgatgaatcctctagtcgttgagcattcagcaaatatttctggcctttaatagccaggcattgaaatcagtgtttatgtcaagttattaaaacttcttgagttttaattcatatatataaagaatatattttgaacatgtccctacataaaaggcctcttgatgaaggaaacatttaatgtttagcatgccatgatataattttgtaagtatggttttatgttatggggttttgttttgtctcatgattttctagataatttttgccattcagaaagcagacatttaatatatacatgacatgcatatggtataagggaaaaaatagctcctgatattcccccatctccctgcccccaatattccaactggaaatagaagagggactgtttaagagagccaaacaggcagtggctaccccttctggactccacttagctgctttatagttaacagatctcatttccttaatacaaatgcgcacgcacacacacagacacacatacacctgggtaaagacatttttattaccagtctccttccttattctgtttctggtgatctcagaactttggagaactgaattatagcttcccttcacaaaatgctgggggaactctttataatactttagctaagcattatggtccctgatgaaatgtgctaaataaaaaaaaaaaagttttcaaatactgttagggttttgtataatctatcctttacaataaaatacccaccactgttaatatgcctgatgtacatctgtactaccatacaaagctgttcataatacatctggattggatgttcacatagcagaatttaccttgttaaatctggctggcattttatttcttcagaatatttctaggaaaacaaaattcccttctcatcagaatgctgtctactttaattaatatgaagtattattcaagatagaaacaacaaaatttctatgcttagcatgcattgaaaccttattattacaaaacagcatctgtttcttagagaattgatgatatccaggagtcagaaattcacgttacagcctcggtatttaactgtgaggtgattttgactaaaccattggacttctgaacttttcttggttaataatatatcaaaacagagtttaaaaatagcccctctcattatatgtatttagtcaacaattatggagtccttaaaaaatgcagatgtcaccttttcatgttggttactagagatcacatcttaactctctttaaggatgagttttacttacagctaactagaccaacaagagaaatgaatgtgaagttacacttactctttgccaacctaccactttatcgtattcttttaaagactttttttggctggaaaagtttatgtgagctcttgaggttagaaagcttaagtcatcttggtaggcaggatatttcttctgataacatatattcttttctgagaatgcattttgggaaatgtagattttcactgtaaatccttcattgtttgaagaactctgtgccagtattacatttcaggcaagactaattttagccaggttcattaaagtattccctgtgttctctccagtaatttcagctggttcctttttatgccctcttgacacagtcacattctacagtgtacagaaaataacctgctgtctgtagaagtggtgaatggtttcatgattcccttctttttagtgtgggtgagttttcttcactctttttctgttgcctgcatccttggccatcatgaatgttttgctttctctcttgcagatgacacaattggtactgcctggcatggtggaaaggtgagtcacaagctcacatacaaacactgtggaagcagagctcatgattatttagagggagaatccttgctttgaaaaaatcactgaagtgactaatgaaccaagcctccatgtcttagccacagagtgatgtaccaggcgagtcacagtagagcatgagtcatcggtggtggaggccttttccactcgattccctttttatttctctctctagggttgtagtggttcctttagatcaggatgaaaaagcctgcctgagtcaccatcactaactcaattgcctactattctgagggggcggatagagttcctgggatattcccgggaataccttcttaaagctgtattctctcaaagccaaaatcagtggagttggatgaagcaagacctcttcctctggtttttcactttttactgggagaatggctgttatataaagtgattataagatgtcaaaccaacccttggaggaaaaggcaatgtccactcgccccatctttgttccagtttgaattggttctgctagtacatgccgaatgtcttcattttgattgagaaatatgttgtagatttctgttatctgaaatagcatgaagtgtagaattgtaattaagctgtttcttccttggaaaaatctgaatgatgtctaggccttcaaagaaaagctgctaaaaagatttgggcttgcatcctgagctagctcgatcatttgctgaatttagggcatcgtagtcatctttttttctgcaaaataactatgagtttggaagagacccagaggaatcacagctttgaaaagggaagacccaaggaccctacttctgttaggaaacctctatgacctactccaggcagggattacagcttatgtttattgagtatatagtaagtgccaggaacttagtaagtgttaactcatttaactttgatagcctcccaccattgtacagatgaggaaactgaggttaggaatccatttgttgagcatctacagggactagttaagaaacagtttctcagcaaagctccttgtaatcccattttatatacactattttgtgtattttaattgttttattttagtaacacttccctttaaaatcttcaaactgcctattgttaggtgccagtgggagtggacccctgatggtcagatatataaatggcagtggttagaccagaccagaaccctagaagatggtagagttggggcaaagtagaacccaggagggattaaatttgggccatcaccttaatcctagttttgacatctgcaggtaacatggtattggttcagaatagtaaatctatccattaaaaaagaaacacttataaaccacagaggtattgtaaaaggaatttttaattatgttgatgaaaaccatatcaaaagagataatggttgcaaaatcattttacagcataaagtcttagagtcaaagagtcacagaaatccagtgcattaaattaattgacagtaacttccctcctttgacagatgaaaaaatagaggcccaaagagatggagtgctatgaagctatacagttagtaaataatacaaaaccaagaagctgggaacttcactgctatctctgtagacctgacagccatgatcacagctggagcattacataaaggcaatgcaaaaaaggagagtccatccattcaataggcattcatttagtcaagcgtctcaaggatgagttggatccttgccttttaagaaatcaagttgaagctgggcgcagtggttcacgcctataatcccagcactttgggaggctgaggtgggtgaatcacttgaggccaggaattcaagaccagcctggtcaacatggcaagacctcatctctactaaaagtacaaaaacattagctgggcgtggtggcacacagctataatcccagctactcaggtggcttaggcacaagaatcacttgaaccctgggaggcattggtcgcagtgagccaagatagtgccactgcactccagcctgggcaacagagcgagaccctgtctcaaaaaaaaaaaaaaaaaaaaaaggaaagatcaagttgattttaaactgaggttgagaaatggtgggaagttttcagaagctatgactgaacctgacaccacattaccattttgatacgtcttaagagctagtgagaaatatatgtggatgttatgaatcaatacttttggttaggaaaaggaacgtctatgtctacttgaattaaagaacttagttactagatgtgtcagtcaaggtaagctacctgctgaaacatgccactcccaaatctcagtggcttaacacataaaggtttacttttccctcccctctctacccgtcattcaggatctgaggctccttccatctaggggcgtcatcattttctagggtcttggagttctctgcatccagctgacagatgaaagacaagagagtaaagatggttttaagggaagtttcacttctgcccacatttcattgtgcagaactcagtcacaggctacaactactgcacagaaggccagaaatattagctgtatgcccaaagaggagagaaaaattccaagttagcagatcatattgaaagcattcttaccttacatattataagtggtttcattatagcctgctctttacaccatccccaaatggcttatttcctatggctggtttccatagcattagtatctccattgagtaacagcagagtcctttatcatgatcctttgttgttgttttccttccactgcttccacctctgatgtgggagattttccaaaccctctagaactatagcctagggccaactgactatcgctaaacaaatacctataatcaaactaaggtattgttaccatagatgtagaaagtacataattacattatagaggaaagttgctcttttcacttccctggaattataaacattgtgtacagctggagccaggaggtggttgccataacaaccatgggaaagctaaaaatagcccctttcataactgtattgcttaaggtggaattatgacatgttatggtgttttagggcaagtaattctctttcatgtgctgaatgtttgcaaactttcttccacaaagcaatatttgtacaatgtaagtatttggattgctggttctaattatacacctgacccctatgttctaagattctttttgacatagatctctatttttataggtttctcagtcttcgtgagcatctgttacagaactgtctgtgccaatttcagtattatatttaagctttaatatatatatataatgacaaccctccccctcaagagcctgcttttgtactccttgatatgaagtggaaatgtgaagaattgggatggaatttttttttttttgtacattcttccttggctacaatcaaattctgtatgcagttagcagtccccactaggattaaccctgcagttccggttcctcatagcagcaggtctctcttcccacctgcactgtgggacagtgatgaggtttctaaggaaggtagaaaacagtgacttacttcaaaggagacctattacgtcctctatgacagtagaatttttatagaggtgtggacaaggataccacaacagtctgatagaatattaaagcacttataaaataaaggcttggcaatttttttttaatccaggtgacaattaagggagtcttattgggaatttcacaggtctgagggaattccatgagagagcatatctataggaagctgtaagtgtgagggactgagttttatagagttgggcgaatttaatgtctggcttgtgggaggactagtaattaaagagaatatgtttatatgaaaaggtactttcctgtcagcaattggtgttttctgctttgggttttttcgcaacattttagttctagtagatcctcagtaatttgtaccactgagacagcattgtgtggctgttagcaagtaagcagtataatgaattaagaatgttgcattacagaaaacattgcttgacttgtttatttggatatttgtcataacaaactagaaaatgcgctgaagtatgagcaacatgagtcttcattatagaacttcagcaaaaattcttaatgtaccttccaatcttagaattgttcccgagtccccagaaaatgagagattaaccagggtttagtttcatgtttgtttctgtgtgcaattaagcgcagcccattttgtccttctgcttgatataacagagttgtcatgagtctggctgtgccatggaaactggtttgacgtcactaattctgcttagatggaggattagagctagacaacacggttgatttaaagggcgagtcttttgtgccttgcagtcccaaatgctcagccccgtttctacatagagaacagatactgtatacagtacaaagattgaggcaggctacaccagtatattagctgtgattcagacagaactaagttgaatattattgcctttggaaagaaagagcgagagagttttacactgttgtgtgtgtgggtgtgggaggaaggtttttgttagacaaatatgtgagcttaatggtaggacagagatttgtagaagggctattttctctactgtcactttggtacaattttaaatgctactcttttatttacttaggtcgagtgcattcttgctttatcatttattagtcttagatttgttttcatgtgttttagcatgcaaatactgtattttgtatgaagtaccctcaaactctgacttttcactaattcaaagcaactccacctcctagaagttttcaataggattagaatacttgagaaacaaaatcttagttgccttaaggagcaaacaagtaagggaggatgactgcatgaatgtgacattggataattgatctgtattgtattttaatatgggaaaggaacttttattatctttaaatgacttttcctgtacttagatcattgctttggtgagtgaagttttaagggtctgttttgatcaggtcaagatttaatttttaaagtgcacttgataatgttaaattttaccttttacagatttttaaattgcattttgttagcgagaaatgaaatttaaaatgtaaggtttctgttcaagggcacatataacaaccccagctaacttgagtataatggagcatttaatccagctgttaggccaagcagtgataggctgcagcttcagtggaaagcctcatttttctgcatctacttcaaactagttgtgtcttcacttgctgtgaatgagtttggacatagctgttcccagttatgtgagaaaaggttaaaataaaacactacccatacctacaaggatgcttaggatgcaggagaagggttgacttgtcaagattgagggttacttcttagaaagcatattgtgttgcatacgatacaatagctctcttagttttcacttgattgggatctgctcccagtttaaaggtgatacattccaatatgtcataaatatttttctctctcttttcatagatttgttgagataaatttcacatactgaacaatctacccattaaagtatacactttaatggtttttagggtattcacagagctgtgcaactatcaccacagtctaatttttgaacattatcaataccccaaaaaagataaagatattttaaatattacaaattaatactaaattaaaaatctcctgtaacaaaagtggtttttctattttcatcaaaggaatttctcagaaatatagataaaatgaaaggactagatattcattgctaatttaccagtttttatgttcgaattgttgggttctaactcctgatacaaattcttaccttaaaatttaaaaagaaaagacttttctgcttctgaggaagacacagacaaaaaataccagaatgatataattaacccattgactacttatttccaactttattcaaaaccctcctaatatttttaaatttgaaatgtaatttttatcatcaaaatcttaatgggtttcacagtttaggaaggcacataatactaataaggacttctgttaaacaacaacaacaacttctttccagtgacacagactaagctgaggactcccacttccctttgatggttgaagtggcatctcacctagaggctggcagatggagcgggtgacttttggggattatttcatttcagatttatgcctaaaataacttaaatgccatttaatcatgtatcctttattattttgcataaagggggtctttatagtcccttttttaagctaaaaaaataggtgttgggaagtaaattcagacaaagaacaatgagaaagtgggttaaggaaaggaacctagtatgggagataggaggtgggtgggatcaggttgcagtggctgaaaaaggggaatcctctgagaagaatggatttgaggggaagatatggtagctgtgacactcctaaaccataattctacactttacctaacctatacatactttttaacaactggtatctttatagcattgcttttctcaagctaattttcacttttttgtagaattagaaattcctggtaactttgattttaaactttcagtagtctctaaaagttacagtaacagttgagctttgccttttggcaaaagacacagtttgatgaactagagtcacataattttagagtcaactctttgttggtgcccaagtatctacaacccagggaaagtagaagtagacagtagaagtagaatctacaacccaaggaaaggacatagccattcactcattgccagaaagttttattaagtacctgttggttatgtgctcagtaccgtgtggaatattttgagggaaagtgggctattatatccagaagcttatggttttgttggggggaggagagaatgtttatatacatagaatgattaaatcctacagtaaagtagtatgtgacgatatgttaaaataaaggtgtatgcagggaatataaaagatctgtaagtaaaaattctcagcactgtggctagagaagacctcagagggtagagatcaactcgaggagactggagatctgatctggttatgccctgggttactaagactgggaaatgagctaatcgtgaagaagagctatttttagttgattgaattatgtctcatttactgaccaagcatagcacatactgatgaaaggcagggagagatatgtggtagaaaaacagctacattattctgtttcgaataattatatatctcaatctgtaattcacaaacaactgcatactgtggcttcactccttttacacggtacattttcctttttagatccaaaggggctattctgaacatttcatctggcagtggcatgctccctgtcccactcttgaccatctattctgcaaccaaggtaaaaaatattttcttaaatcatgtcaatatagtaataaggggtaatttttagtctgagaaattaacgtagatttaactttcctgaagttctgttcttggcagttttccagtagactgagaagaaaaggaaaataccctacttgagtttcaaaagaaccagagttggagacatactatatacttacaataaacttaatgtaaacttacaaatgggacaccaggatatcagattcacagatgctgtttttctccccccagcactctactgattttgaaagtgatacttgtgccttccatagacaggtgacctaggcagatagcttagttaattagaacatgatgttaatgagtctaagattggagatttgatacatgaatgagtccacttcacacagcatagaagaaatgcatctagtcaatgtgtaaatgtacatagcaggcacaagatagactgggcgagagtgtattttgccatgttgtccaggattcatagatattctttgtcacttttggggtgagacaagaattttccagaactctctggacaatgtcataatttcatacaatatcaccattaacctcttcacattactgataggaaagtaatttagaatgagtctcctactgcctgcaggtcaatggcgtcatcttcagatacattgttgaggcattgaatacatctctgaagggaaaatgatcacttagatgttgaaattaagcaggcttttagggaaaaataaacaaaaatatgtacagtaagaacttgaaacatttcagggaaggaaaagagcaaaactccgacttctttttcatgtgaaaaaacagtcaccactgtcttttgaaaagcttggtaccacctcccagcccctacaatctactttctgtatctgggaacatactgtaggcaaatttaaaatgaatgccatgtttcttgaagggattcgtgaacttcaacttatctgttctactccatggctacaaaactatgactaattaggacccttgaaaagtcacttgattctttgcatttctagtctgaggttgcgtccacatttgaaaaatggcacattgtattttacaaatagatttaaggttgtattatcagaagaagatgggctgtcacattcacctctatacttcttggatcttgtcatcccaaagcaccaagaggatgcttgttctgttctttttagcaacaacaaaatccccatagaacagagttgaatggacttcatcttgtgtttctatttgagtggcaagtggagagatgaaatgagtcttttgttatataagagaaaaatattttttcttggaaagtaattttctgaggggagaaaaagataagaaaagccttttccagttaaatcaaaatttgatctggatattatatttggtaatataatacttcatttagtggcagataaaaacagcttgaggttttcaggtgtttttctaagttctcttctgcgtttgaaatgaaaaaaatgatgagaaattatagcattaaatgattagtttattattttgtttccatggctacaaatcaggcagattgatgtaatgtgtgtgttttcttctcactcccactcccctcccagacttttgtagatttcttctctcagtgcctccatgaggagtataggagcaagggcgtctttgtgcaggtgagtggagtttgtttcacttaagtatccctgtttttgtgtggtttccagagcaactgttgctgtcttggcaataacaaaaaaaatcatattcctaagtaagtgaatgtgacattagcacaccattaaaaacgtggtttctttttccttaatgcacttgtctagatttttaaaaaattatcccctagaattttcaagtagggatacctaaagtggaactaaatgcagtataaatagctgaagcatactttttaagttcttagggttttattttgagagaccgagactatcggcatctctctcttttttaattgtggtaaaataaacataaaatttaccattttcatcatttttaatatgcagttcaatggcattaagtacattcacatatcgtgcaaccattgtcaccgtccatctccagaacttttttcatcttccaaaactgaaactctgtacccatcaaacatgaactccccatttccccttccctccagcccctggcaacctatctatctctatgaatttgactactcttagtacctcatatgggtggaatcatacagtatttgatcttttgtgactggattatttcacttagcatgtcttcagagttcatccatgttgaagtatgtgtcggaattttcttccttttcaaggctgaataaaatgccattgtatatagaccacattttgcttatccatttacatgttagtgggcatctgggttgtttctacctgttgggtattgtaaataatgctaatatgagcatgagtgtacaaatatctcttgcaaactctgttttcaattcttttgtatatgtatacagaagtggaattgctgggtcatatggtaattctgttttaaattttttgaagaacttagctattttccatgtcagctacaccagtttacacttccactggcagtgtgcagagttccagtttctccacatcttcaccaacacttgttattttctattttgtttgttttttataatagccatcataacgggtatgaagtggtatctcattgtggttttgatttgcttttccctgatgattagtgatattgagcattttttcatgagtttatttggtcatttgcctatcacctttgaagaaatgtctattccagtcctttgcatatgtttaataaaatcgtgttgtttggtttcttgtcattgggttgtaggaatgatctatatattctggatgttgtcccattttagatacatgatttgcaaagattttctcccacttcgtgagttgccattttattctgtctttagtctgcataatatctttttattcacaaaagtttttaattttgatgtagtccagtttatctattttttattttgttgctggtgcttttggtgtcaaatccaagaaatgcttgccaaatccagtgtcatgaagcttttcccctgttttcctgtaagagttttctagttctagctctttgatccattttgagttaacttttatatacctttgagtttattatgtagctagcagatataatgctgtgaaaacacaaaatatgagagaaagcaaatataggagttttgatggttggcaatttcaaattaaccattcttcaattgaaagaaatagtatttccatgctcaggcacttttaaaaaatgtcttgggagaagttgcaatttgtacctctttgctgctcctgcctatcagctaccccacctctgtgcacgtctggtgttcattgtggctttcattcctgtgaggcaagtatttcactttttgtatcctgaagccacaaatgatcgatcaaaataataatagtgaatatttgagtggatacttttcaggtacagtgctaaacactttaatatgtatcatttcactgcatctcataacaatctcatacaatggtgtgatgatgattattattatttttaattgcagaaattggggcttagagagggtaagccacttgcccatgttgaactgggactcaaatctgggtctgtttggcactaaagcctttgttcttaaccactaggctacttgctccaggcctgtaagtcaacattgaacacttactggatccatctgtgctcagggagtgatggaaccagaaggtggttggttagttccatttcctcctttatgcctgtagagcatcaagatgggtgtaaatgtcatgtagatgtagcttctaaacctttttattgagtagatactggtgggagctaagtcacctactgtgagatagaatggtaatgaaaggaaggggggatgactgtttcctcatcttccaggatcatctaagagcctgcttcctctaaaccccgacctgagctttcatccaagggaagcttagatgtcatagccacttggtgttatttctgacttgcagcttcccatatgtataggtttcattcggaaggacatgtgttctagaatcctggattttatactaaattactgtactctctttttcccctttccttgacaccagtcattttaatgttagtaatgcgaatgttctatgtagaatatgttgtattttagtaacaaggacaccagtaaaatgttcttgagaagctattacattccatgagaaggtattcatgggaaggtatcacatgccaggcaatggtataccattttctttctgatgaatctaattgtaattacactattaactgaatagtttgtaaacacctattgcgactaggcaggaatcctaaaaaggtccattggtgattgactataagcagagtgaccagaagctgtaagtgtctcagtgacagaaggtagcattaggccttgtgaacagacaatcaatttctaaaattccgttaataagcaagactgtctcctctctcattctcacaacttgtttccctcaaagatcttttctccagattttccacctagtaatctggtgtgactagaagctactgtaaaaacacattagcatttgtcttctgaaatattttattttgataaacttttgtttttccctaataatgaagtataaactgtcatttcatctgtcattgtgttttgtcatatgaattcattcaaggtttaaactttgaatgaatttgatgaaaaaataaagactcaaatgtttgtgagggaaagcacagtcgtcattctgtgtgaatacatcagaatgttgaagtagaatagaaagagaacctcttattaattctgatcaaaggggcaaaaaaaatgtagtctaaatgaagctcagagttaaaaatgattggtttttctttggcggtgtttatgcccacaaattttttggactaggagtatttatcagctgattctgcctcgtactccagcccacacatgtttcctgggtgatcttattaaaatacaaatcagataatgttgctttccttcctagtcctccagtggctgcccataaggtttaggattaaattcgaactccacaaggccatctcctttcttgccactccattgtcctccccgacgttcaggccagagtggacatcccagtgtctagtacatgctctgccctctgaagtgcccatgactggctcctctgttggcatcctttccccaactcctctccagttcttctcactgtatctcctcccagccctatttgcacctgaaccctatggctgctgtccctctctcaaggcttgggccacagttcccctgccctggaaagccttctctcagctccttggcacatttggttaggcctttctttgggctctcgttggagctccttgtatacctctgcctgctactgtctggcccttccctgtctccccacttccatgtattctcgagaacagggctttttatcttatttgtctctgtgttgctggcggcacttgttgtttgtggtaaacgggagacccaccttttccatggcatcacagaaaactctggttgtgcatggtcaagctttgtggtacacaggcatctgttttgatggctttttgagcttcttctattgctcccatatgctcctggccttgaattttcagcctctttatctgaatggcttctagactaatgctatgtggccatgtttccatttttttctaagccttgcaaagaatgctatctttttaggtctacctccgtgtgaatgtacatcagattgctcttttggggaaggaagagggtatattgttcaaattctagattgtttcagattacttcttaatatttttcttttgcatttctctccccatctttccctcaacttcttaacttctttcctataattttataagatcatttaaaattgccttcaagaattcagatttgccattatataatcatttcctgggaatgcaaaaacacagtaacaacaacaagtgatgtaaatgccctggaggtgaatgatgggcctgagagactatttgattttgaacagaggatgagaagcacattctcaaggaaaccttatcataagtgtagtctgttgatgaggactgtttgttctcattaccttataattaaagtccagtcaaaaaaaaaaaaagacacttgtgtctttcaaaaggcaaaattattataagtaatttgactggctaggtagtgggccctagccctgggctccttctgtctaccctgtactgactagcagttaatactgagcaagcaggaagtagctaagactaagactaaatcctaaaactatacctcttgaactcttattctgcaaaattttcataagccttctgtttttaaaaaaattatttggaaataatttcaagtctacagaaaagttacaagaataaaaatagtgcagacaatactctgataccctttgcttagatttcttactgttaacattttaccgcatttgtcttatcattggagagtaagtgcaaacattatggtccttcaattctaaattcttgagtgtgtacttctgaaaaataaggggttgtttgtttgtttgtttgtttgttgtttgaagacaggttctcactctgtcacccaggctggagtgtagtggagctatcatggctcactagagccttgacctcccaggctcaagtgatcctcccacctcagcctcctgtgtggctaggaccgcaggcacatgccaccaagcctagcattttttgttgagacagggtctcactttgtcacctaggctggtctcaaactcctgagctcaagtaattctcccgcattggcttcccaaagtgctgagattacaggcgtgagccaccacacccaaccagaataaggatattctcatatgtaaccacaatacccgtatcaactcagatttaacagtgatacaataattttatctaatgtattatttgtgcccaatttttgatcttacaatattctttatcctctcctcttcctccactaaagaatgcaatctaggatcaggtgtcatatttagttgtcctgtctcttttatttcctttaacctgggatatatctaaaacctttgtgtttcatgacagtgacattttttaagagtacagtattcctcctttttaattatacattcctcatttggggtttctttgatgcttccttagagaaacccaaaagtgagattcggattatgctttccgggccaaaatatcacatatgtatgtgatgttgtgtcgtcagggcctcacgtggggagacacagaagatccatctgctcttcattggtggcgatgtttctgatcccccactctaggtgttacccaacttctctgccatataattactattatttcccttgcactaacaagcaactgtggggagaccctaaaactgtgcaaatattttggcccttatcaaaatttcccctagatgtagcatcagtgatgtttcttcacaaacctgcctcataaagagatttttgatgctaaagaattcctgaagccctgcctggatatttcgtcatttcaaaatgaaaagtcacagctaaagcatggtcacagtgtcctcagtccaggctgtggttttatgaaaactgcattggtcatcggtgtgccttgaggcagagaggaaaggacactgagcttggagtcagcagaccaaggtttgagttctgccttcaacatccggtgatcatctgacctacagaaagttgcttcattactttatgccttaatctccccttctggcaagtgggataagtgatgtgagataaaagcactccaagctgggaaatgatatataagggtgaagaagagaggaaagagacttatattcattggatatctacaatatgcccaagttttcacctcatttgtcaactcattttacatagatattaacctagtcccattttacaaataggaaacaggatcaacaggagccctgtgctgggcacggtggctcacacctgtaatcccagcactttgggaggctgaggcaggcagatcacttgaggtcaggagttcaaggccagcctggccaacatggcgaaatcccgtctctcctaaaaatacaaaaattagccaggtgtggtggtgcatgcctataaacccagctactgtagggggctgaggcatgaaaatggttttaacctgggaggcagaggttgctgtgagctgagatcacacccctgcatactagcctgggcaacagaacaagactttgtctcaaaaaaataaaaataaagaggagtcctgaaacttgcttaaagtcaatttagtttatcaaacagctcctgcctgctatttattagacccttggctagacatctaggaaacaaaggtaaataagacccagtccctgtgctgaaggcacacacacacaaaagacaaatatttaaacacattacacccacagtaagtccaaaactggaggtatatatcatgttccacatgtcttcagtcaagaaatatttagaaagcacctaataatctggcaaaaggcacacagagcctctgctgtggttgaatttacatttattgggagggagacagacattaaacaaatccacaaataagacaattgtatagagtgatacgttctcgagaagaaactaaaaaagagtgatatgttcaagaacatggggaagtgtagagagaatgtactgatcttggtgtgagtaactccgtctgcagtgccatcctgtttctcaaagaggtgttgctctccgtcacgcagtttccttcctttgacctgggaggccgggtctctggaaatgctcttaacaaggagatcatctgccaagggacaccatcccctgaggttttctttaccagaagaaaggtggggatgcagatagaggccatctaaacccagagaactttcagctgccctgaaaatgaagtggactttttcattcttagcaggagattacaaaagaatactccatttacatttgaacttattgtcctgaagaaatcctctgggcgccatgcacggtggctcacgcctataatcccagcattttgggaggccaaggcaggagggtcgcttgagcccaggagtttaacaccagcctgggtaacatagtgagacactgtctctacaaaaaatagaaatacattagctgggcgtggtggtgcatgcctgtggtcccagccactcaggaagctgagacaggagaatcacttgagcccaggaggttgaaggtgcagtgagctgtgatggtgtcactgcactccagcctcggtgatgggtggcagagcaagactctgcctcacaaaaaaaaaaaaaaaaaagagaaatcctctaggctccatttgcttgttactactttccagtgcctttgtcttggtgatgagagttggtggttttgttagttcaggtaaaagtgtagtttttaatcagaatagacttgatttgggttaatccatgaaatttagaaaacaaataggacaaattgagatgagagaaaacacaatttaagaattttttaatgaaagaagatattccttctttgtatttttgttacagtattttattgcttagggtattcatatagttctattgggcttcaaagaactagaaagctaaatattgagaaacggctaccgggattacaaatataagtctccatcctttcttcctgttaattgccagtgactatgaaaggagttaatagagtgtgtcttttgtgcatatggagtctaaatagggagagttataaagcaatataaagattctcgctggaaatgttcatgtatggccaactataccaattttgaaaaatggcttaagaatagtaaaattagtccttttgggctcattggactcagatcccttccaaccagctgaatctcgattttttcagtgatctccttttttcttggccatttacaacagtgttgtaccacaagacctacaagcttaagaggtccctccaaaccattacatgtgtgtccaggagaactaagatattcagttggttacctcaacagtcagatattctccatggaaaatggcattcttatgcgtcttattggatataaaaagtcagccaagctcttctttccaaattcattctaaaaatatagattttggaaaacttagaaaataattgctaatacatactaaagtttcaaatcccacactctttaactgataatattttatttaattctcatgatagtataataaggaagattctatagcctctaattacagaggaagaaactaaggctcagtcattgagtgttttgctcaagatcacacaactagtaagtggtcaagctggaatttgaatccaagttggtctgattataaccaatgctgatttttttttcctgttaccctaccacctctattttcacatcccaaacttaatcctttaggaaatccttgcagcatacccactatttgactacttctcatgacctccactactaccactctatctgagccaccatcatagcttgtcctggacattttgcagtatcttactatctggccttcctacacccatcgtggtttaacagcccctatagcctactcatagcagccagaatgatctctttaaaataaaatccagctgggcacagtgactcacacatgtaatcccaacactttgggaggctgagatgtatggattgcttgggctcattgagttcaagaccagtctgggcaacatggtgaaaccctgtctctacaaaaaaattaaaaaattagccaggcatggtggtgtgcacctgtggtccttgatacttgggaggctgaggtgggaggatggcttgagcccgggaggtggaggttgcagtgagctgagatcgcaccactgcactccagcctgggtgacagagcgagactatctcaaacaaaacaaaacaaaacaaaaaaatccagttacttcactgctatgctaaaaattcttccttggcttctcatctctttcacaatgaaaccatgagtttttatgaccctcaatgttctgatttcaaacttccacgttatcatgtcccctccccaccttcctacttctgtggcctccttccaattctggaaacactttgaggatgccttcacctcagggcctttgcacttgttccttcagtctcaaaggctcttcacccagatattcttttggccaactccatctctttgttcagatctttggttataagtcaccacatcaaaggggcctttcttgagaactcacctgcaggctcagcctctatcagctcttttacccaggtatttttttcatcttgcttttttatcattgcctgccaatactgtacacctttgttttaattattatttgtttgtggtctatatcctcctactgaaatgtaagctctgtaagattagggactctgtttttattcacaatgaattttattcattaagttcccatgcctaaaacattgttctagtaggtgctcaggaaatagtttagtgttaagtgaatgccttttgtgagattacactgtttttctttttgttccttgaatgttaacatacaaattccacatctttggaggtaggttatttacaagattatcagccaacatttatcaaggatctttgtgtagagcacaatactttgaactccttcattttggatttagatgctaagatttatatgtattgttattgcagggccttttttcattgctatataaccagggatctctgcaccagcagaacaactcctttttcctaaaatttctagaaagtctaagggtttctgccaagtagataatcaagggcctttatatggaaaagctaatttcgtggtctgcaagtaaagtaatacgcactccaaaactataatataggtgtataattatttaagtttttgtataccagatcctgaaatcgtagatgaatacacagatttcaggaaatggagttttcctaatattcttcataggagccccagcttctgccttaagagtgtgtgctggctacacggttgaatttaatgctcggtaaaggcagatgtgacaccatgtatgaaatctcatactgtgcaaatacactagaccctagtgtattctgggtcttcattttcccaggtcattgtcatctgatgttctggtcatttttcagttgaaaagcatgtttagtacacagatgatgacacctgaaagatgccctaccatgttaagttccaaggttcaatccctgattcttgaatatctgccatgcagtttcaggcatctttctttccactactccatggccataagccttcctcttctgaatcaagccccctgaattgtactgtgcagtccagttatctaagcaagctgctccagtgggtgagaaaaaagataccaagttgtcgggcctggtgcggtggttcatgcctgtaatcccagcacttgggaggctgaggcaggcggatcacctgaggtcgggagttcgagaccagcctggccaacatggagaaactccatctctactaaaaatacaaaattagccgggcgtggtggcaggcgcctgtaatcgcagctactcaggaggctgaggcaggggaattgcttgaaccagggaggtggaggttgcagtgagccgagatggcgccactgcactccaggctgggtgacagagcgaggctccatctcaagataccaagttgtctccagtgattttattttttttatttttattgttttaaaataggctgagcaaggaagcaccaacagctttgctttatggcctaattaattatttgccatgtgggaatgctaaatttgaagaccaggatacttgcccacatctgcagctctcaaggtcaggttgtttctgagctggcaatatttgtaatgggaacttgttgaaattgagcaacttgaaaaatctgttctgcccacaatttcctataaaagtatgagtatcttcttgacctgtttcccataatgttttcctgagtaagcaggagaaatcaactaattatcccttgttgggtttttatttaacagttgaagggtgtacctagatggctttttgatatctaagatatttctttactttcatataacttggaatatttatttttaaatcattggcaagtagctataagtatgcctgtttagataggtgctcttatatatgcttcagaatttctaaaattttggcttaaacattcatattatcaacttcttggtgtaattaattttctggatcatagcagtggaaagagaccccagtactcttcttcggtgctgtccataatgaagtgtctttcaccaattcattcaatagatattaattgtacccctgctatgtaccaagtactgttctaaaacattaaaatatatgaatatgaccaagccttcatggagcttgtgttctagaaatggatactgcccagtgattggattcagttttctgtaccgttttgcctccctcctgccactcttcacacatttccaacatttgaaccatcctgagctatgcagttccctgaaaaacatcatgctcttctgtggctccttttcttggctcctgctgttcccttatttgtttacaattagggaaattcttgcacttcatttaagacttagctcaaacgctgtttcgtctttgaaccctccactaggccatgttaactgccttgattttaaaccatcgtggaaataaatatactttctagaaaagaatttacatttcttagctggaaaaacataacccaacttggaattcctgagtatgcatctcttgtccccaccccttgatctgggggttctctagactagctctatggtttagctgcatgaagagttaacttgtggcaccaccaagtggttcagtcaggcagtgcaacttaattctcctacaagatcaaagtagtccaatttataccatgttacatacgaagggagggaagaagatggcaaaaaggatggacgaaaggaacaaaaaattataacgcagttgagaggtataatgattagaccatctctacctctagaagctcaaaatcttacaatacctttaccaggcttgtgatctatatttgggtttttttttttaatcttcactattttgtgacctttaaacctaatgcatagaaatgagaaatggtttgcttatgttccttcattatgtgagatcagagtatttacatatactctttctttccttactgctcaactttactctgggaaataaccttttctttactgacccattgtgagagcctcactgaactctgcatttcctactcagtctgagtcggagatctcaccctagtgtgtgctctcatagactatatccttgtggcaaaatggtccttaaaagatgtgacaaaaaatttttttttctaagtgagggataaatatatagtgataatcccaataaacaaattctcagaaatcaaaagttacctaatcaaagttggctcaaatattgaagtacttcatacttagtatgagtctgtggctgcagcaacaaggaaagaggaagatagagagtgacagcactccatctggggttcttggttctaatgaagaggctgaggtttcatctaacctgtcaaggagagtgggttgcattccttgacttagacttcggagtgggaaaaatgcaaagcacacacgtacataaaaacccagagacggccgggcgcggtggctcacgcctgtaatcccagcactttggaggccgaggtgggtgcatcacaaggtcaggagatcgagaccatcctggctaacatggtgaaaccctgtctctactaaaaatacaaaaaattagccaggcgtggtggcgggcgcctgtagtcccagctactggggaggctgaggcaggagaatggtgtgaacccaggaggcggaacttgtggtgagcagagatcgcgccactgcactccagcttggggactctcgctgagactctgtctcaaaaaaaaaaaaaaaaaaaaaaaaaaaccagagacatgggaccactccttctaggtctcagcaggacggaaatccatagaatggaacagatctcaatttgattgaaattttaagattttgaccaccatgtgttagaaccattccttttctttaatggaagtgtcattgggccaagcgtggtagctcacacctgtcatcccgacacttggggaggctgaagtgggaggatcacatgagcccagaagtttgagaccagcctgggcagcatgttgaaaccttgtctctacaaaaaaaattttaaattagctgggcatggtggtgcacacctgtggttccaactactcagaaggctgagacaggaggatcccttgagcccaagagctcaaggctgcagtgagctatgatcgtgccaccgcactccagcctaagcaacaagcaaaaccctgcctcaaaaaaaaaagaagaaaaagaaaaaaagaagtatcattgcagtgatacttcacacatgtgagataaacaatacattcactctttgttgaactaccatgcccaggttatttcaaactacagaaggacctcttgtatcatgactcaggacttgttacaatagggtttccttatactctgtgttgaatcacatccaaaatgcagcaagcttaagcaataaagaacctaacattattgaagttcctctaaaggtcatgtccagatttgtcaccctacacccatccagtcaggtgtcttttagttacccaaacagtttccatattgttagactgtgtttcttctaaaaaagaaaaaaagggaggtggttctatcttatcaataaaattgtttataaaactcagaagtagaatggtgagaaactagggaagaaaagtagtaacgcaagtctgagaaataagatgtctattttagaaggatcaaagctgatagaacaagcttaattagccataaattatggagaaagttggcattatcccattagaagaataaagtatcaaagatctcctacttggtggttctgtctcaatgttgagtttactaagtgtgaaaagtatcctatcctgaatctgtgctctctggattatttaatgctttcctttttaaaggttcaaaaaggtagatttctgcttatttttaatactttctctggtctcaaactctgttttattgagagattgatttgttacaatttgttttatggtatcatgtgttctatcaagttggctttagatagccacttctcttttcttctctctctgtaaagatacagatgtttctaccactaagagcagtcaagcaccactgtacattctgagtttgtggccttactaatcaatggcatgttttctggggtgggtgttccctttctagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatggtaggtagattttttgaatcacaaatcaatactttctggcttggggtttctttcccattgagttacaggatagtatgtaatagattagcacatatacattgtccagccatagtaacaagatatctatatcttgttataattataatggtcgtatacccaagaactttaaaatctacctataaataaaaacaacactataataaaacattaaatcatatgcttcaatttagcccaaattgtaggctataattacatatctctctcattctgtttccctagggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 209 - DNA, 94954 bp, Homo sapiens
gagaagaagtggcaggtgatgctgaagcgggggagaagcggcagagccggccacacagtgcaggggatggagacaggtgctgggctggtcctcctgcagcatcctcagttgttggagggcagtcatcctcaggccgtacccagccagagaagaaaaagaacagtgtgaagccacgtgtgatagccgtccaacatcggctcttccctccaattacattgtagttgattgtggtatgtcagactgaagtatctcttttatttcgagacagagtctcactctgtcgcccaggctggagtgtagttgcgcgatctccgatcactgcaatctctgcctcctctgttaaagcgattcttgtgccccagcctcccgagtagctgggattacaggcatgagccaccacactcagctaatttttgtatttttattagagaccgggggtttcaccatgttggccaggctggtctcgaactgccgacctcaggtgatccgcccccctcggcctcccaaagagctgggattacaggcgtgagcaaccgccccagccagacttaaggtatctccatgcccaacttttgatagaggtagccatagaaagctagaaatgaaacgacaggttctgttttaacgtttgatggcacagtcgagagtcaataggcacgcattatgcttaagagaagctggaaatgaagtgtttgaaaaccctttaatactatagtaaagcactgttaagaagcaaataatagagtcagctggggctttgtcttctttattgctaggagaatgtagcaatagaagttctcatcgccctgtattgcacttttggttttaaggactggacccagagttcctgaaagccaaactccatagctgctcagtaagttccaagcacatagccggctttgggatgcgattcggtcgaggtctgttgaatgaaggtagacgcagcaggcagtttgtccttaccagtgacctggaagacggtggcacttcctgagtgagctcacttaccttccctgaatggtgaggcatggatgaatattcctggtggtgccacgtgttagaggtggtaaagggtcaaatgtttacttttattaatattacattatggcttggttctctgtgtcagcgatttttctatgccttgggtacttatttcctaatatatatcagcacagtaacgcctagctggaggctttgtcttgttagttgatagattagtggtaacaggtagatttggttatctcccgtaggtgcttagcaatttacatcaagaggcttttctttaagtctgatttaagtctttccatctttaatttaaatccatttctttttactccgaccccagtgactgtcgttgagtgtgtatttgcccgacttgccgtgccagattggtaggcagtggtttggaatcttcattttaaaatcctgtttttctctctccaatacccttcactgcttggtaagtttttatacttctcaatgagacccagagtctcgtgacctaccatttgcctccttcatgatgaaacaactcacaagttggtagatagcctccagttggcagaatcctatgtataatgtgtctttaaaacttgaagagtttgaaggtattatagcctggagcagtaagttttatggctataccttggtaataagacatttgaataacttggcttagcggctttggtaattaactgtgatttttggaatccacctcccctgctgtcagcttgaatcttcattttagtaacacactattactaacactaaacgcttattacatgtgtgtttcaagacaagcgtgagggagttgctcaccctggggtccaaatgaagcagtcagtggcaacccatgtgtagtggggaatggccagaatcctgccggggccacttggtgggctgccttgctcttgattttcagcaggaagctggtggaagctggggttgggcatctgtctctgctcaacttctcagtcagaaaggaaggagaagaaaaaaaaatctgttgggaggtaaactgtgttttaatacaagataaaactcttaatgtcactttcaggattaaaatgatgataaagtaaacatttttactaatttgattcactgactgcaattcagtctttttctgctaaagcctttgaatgttgtatttcggtgatcaggtttgtcagtttatgttaaaattgttaacaagaaatgaggaagaaggctgggtgcggtggttcacgcctgtaatcccagcactttgggaggccgaggcgggcggatcacctgaggtcaggaattcgagaccagcctggccaacgtggtgaaaccctgtctctactaaaaatacaaaagaattagccaggtgtggttatgcatgcctgtagacccagctactctggaggctgaggcaggagaatcatttgaacctgggaggcagaagttgcagtgagccgagattgtgtcactgcactccagcctgggtgacagagcgagactctgtctcaaaaaacaaacaaacaaaaaatggtacttatttttataatctttgaatttagaattttactagtgtttttttgtttgtaacccaggctggagtgcagtgtcatgatctcggctgactgcaacctccgcctcccaggttcaagcaattctcctgcctcagcctcctgagtagctgggactacaggcacgtgccaccacacctggctaattttttgtatttttaggagagacagggtttcactgtgttagccagaatagtgttgatctcctgacctcgtgatcctcctgccttggcctcccaaagtgctgggattacagacgtgagccaccgcgcctggccgaaacaattcttttgaaagagagaagtctccctgtgttgcgcaggctggtctcagactcctggggtcaagtgagcctcctgctttcgcctcctaaagtgctgggattacaggcgtgagccaccgcacccggacagatgtgttgattttaaagtgggtatgaggcctgagccctggagtttgagaccagcctggacaacatggcaagaccctgtctctccaaaaaaaaaaaaaaaaaaacacagctgtggtagtgcgggcacctgtgtgatcccagctgctcaggaggctaaggtcagaggatggcttcagccaaggagttgaggctgcagtgagccatgttcacgccactgctggatgacacagtagaaccctgagtctgaataaataaatacatgagtaagtgggaaggagggaaggaaggaaggatctaggtttaaaaattatttggctttggtggttatgactaagctgtattagatgaagggaggagctaaagatggggaaagcatccttcggaaactttaaagttggaactggtaattttactccgcaaaaaatatatggtacaaagtaactttgttagtgacagattgaatttctgcatttacctatttctgaaataaaatgaaagggataaatgaccttagaatattgatttaaacttctattttatttgagacaaggtctcacttggtcacccaggctggagtgcagtggtgcaatctcggctcactgcagcctccgcttctagggctcaagcgatcctcccacctcggactcccgagtagctgggaccacagggaggtgccaccgtgcccagctaatttttgtacttttctgtaggacaaggtatcatcatgttgcccaggctggtctcgaactcctggactcaagtgatccacccaccttggcctccgaaagtgttgggattacaggtgtgagccactgtgcccagcctaagcatccgtttttaaatttaaaataagatggtctctttttataaaaggaatcataattataaacaaaaagttcattggttagtatgggattgcagtttgcctagaagacgttttatatacccctgactaaacagtagaattgtatgctgaccaagatcgtcctcatctattcagtgcattatgatatgacatttatggttcctggcaagataggtatgttcagctgcactggagacatggctttaaacttattcggaaagggaggtgtccagaatgcaaacagctcttaaaaagtatttggaaataatttattcaatataaggtcatctgatcatttgattatatgttttgaattgccctccggtatgtgccagcaaaaccatcagatcgttaatatgaattagaagctctgatttggagctgcttgaattgttatggatatttttcctcacagttgagtctataaacttgtggtgtttgtaaaacaatgtgcttttcttatgagccaacataagttaaggaatgtttgggcttagttgaagcattataggggatataatatatcttttgtttgttttaggaggctgtgttatttttttctttgtaaacactgagagacgtctgtccacatattacatttctttaaactcttttaacagtattttttaaaattaataataggtacctggataggtgtggtggcttacgcctgtaatcccagcactttgggaggcccaggcgggcggatcacgaggtcaggagatcgagaccatcctggctaacacagtgaaaccccgtctctactaaaaatacaaaaaattagccagacgtggtggggggcacctgtagtcccagctactctggaggctgaggcaggggaatggcatgaacctgggaggcggagcttgcagtgagccaagatagcaccactgcactacagccctgggcgacagagcaagactccatctcaaaaaagataaataaaaataaataactaactaaatataataggtacctatttgacatagctgtaatgtcaatttacatatgaactattcgagaataagagttatttagagaaatactacttgagagagagataaagctttgtttttgttatttaaaatgttaaacaaatgctgtttttttttttttaaagagacaaggtctcactttgtcactgaggctggagtgcagtggggctatctcagctcactgcagccttgacctccccagcccaagcaatcctcctacctcagcctccccagtagctgggactacaggcctgcgccaccatgcttggctacttttttttttttttgagacagagtctcgttctgtcgcccaggctggagtgcagcggcgcgatctctgctcactgcaagctccgcctcccgggttcatgccattctcctgcctcagcctcctgagtagctgggactacaggctcccgccaccacgcctggctaattttttgtatttttagtagagacggggtttcaccgtgttagccagggtggtctcgatctcctgatcttgtgacctccctgcctcggcctcccaaagtgttgggattacaggcttgagccgctgcgcccggcccatgcttggctaatttttgtatttttttgtagagaccaggcttcactatgttgcccaggctggtctcgaactcctgggctcaagtgatctgccagctgtcctgggattacaggtgtgagccactgtgcccggtcaacaaatgctttgtaagaaaggactgatcttctgttgcaggattttctaactggcttagctgttaaaaataacttacctaggtagcattatttgaaatatagaaatttggcattttggggtctttaatatctagtctatccactgacattcttagtctgttgtaaagtggtgctgatgccttctacttaggaacactaggtatttcgaggaggtgtttaatatttgtaaaagattatcattattacagttatcttattgaacaacttctttaggcattttgctaagttttttacgtaaagtatctctcttaagtcacaaccactgtacaaagtacagataataatgctgttttctaggtgagaaccctgaagctgaaagagatttgccagaggccacagccatgtggtagcgatgacctgcctccccacattgccttgttcctatgctgccccactgcccaaggactctgacagttcctgtgcattgctttatcatccctaagtcaattttagcgttttgtttttacttcattatgattattgttgttcattgttatttatagcgatgaggtcttgctgtgttgcccaggttggtctcaaacttctgggcccaagcagtcttcccgtttctacctcccaaagtgctgggattgctgagttgggccaccacacctggccgttgttgttacgtttattaggtagaactggataagctgtgtgtgtgtgtgtgtgtgtgtgtgtgtgtaagatagtgtcttgctctgttgtccaggctggagtacagtggcacgatttcagctcactgcagcctggacctgctgggatcaagcaatcctcttgcctgtgcctcctgagtagctgggaccacaggcatgtgccaccatccccggttaattttggttttaatagacataagggtcttgctatatcagctgaggaagatctgaaacttctgggctcaagcgatcctcccacctcagcctcccaaagtgctgagggggttacaggcatgagccactgtgccctgccgagacacttttcttttctttttctttttcttttttttttttgagacggagtcttgctctgtcacccaggcaggagtgcagtgatgcacgatcttggctcgctgcagcctctacctcctgggtttaaacgattctcctgccttggcttccctagtagctgggattacaggcacctgccaccaaacgctgctaatttttgtatttttagtagagacagggtttcaccatgttggccaggctggtctcaaactcctgacctcaagtgatccaccgaccttggcctcccaaagtgctgggattacaagtatgagccaccgcacctggctgaagcttttctttatagatgtcagcatctataaattggtaacagagagatagcacctactttataggagtgtgggtttctctgggttatttatgttttcaaaggcaattgtgtcaaggagagaaataccagccgggaagatggggaggtgatgtggccctaccatgcctacttggtgcactttggaatgagttggacaaggtaaacctgatgttctttggcctgtgtttcacagcatgagcatatcgctgggctgagactggatggaatgtctaagctgtatttctcatacaacatgatccctaaaacaacctaaatattgctctcgggctcatcctgataggaaggtgactaaaggtgttggggaggaggaaatgggctcagtgggactatgtgagacgtggtatgtcagtatccaacatggtgccttcttcaaggattttccctcgtaattttgacggttcctgatttgagtaagtgtacactgtgactcctgggttacatggcactggactgtgagtagaaggatccttaagttaaacagtttcagagctgaatagagcttccagtcttttattctgttcagtatcgggggaaccagcccccaatattttaatataggttctttctgttttccctaagtgttggccggtctgagaaatagacagagtacaaagagaggaatttcacagctgggcctctgggggtgacatcacatattggtaggaccgtaatgatgaccccgagccccaaaccagcaagtttttattagggattttaaaaggggagggggtgtatgaacagggagtaggtcacaaggatcccatgcttcaaagggcaataagatcacaaggcaaaggcaaaattagaattactgatgagggtctatgtcctgctgtgcacatattgtcttgataaacatcttaacaggaaacagggttcaagagcagagaaccagtctgactagaatttaccaggctggaatttcccaatcctagtaagcctgagggtactgtaggagaccagggcgtatttcagtccttatctcaactgcataagacaatcccagagcggccgttaatagacctccccccaggaatgcattccttccacacggtatcaattattaatattccttgctgggaaaagaattcagcgatatctctcctacttacacgttcatttataggctctctgcaagaagaaaaatatggctgtattctgcccgaccccgcaggcagtcagaccttatggttatcttccattgttccctgaaaattgctgttattctgttcttttcagggtacagtgatttcatattgttcaaacacacgttttacaatcagtttgtacagtagtggtcctgaggtgacgtacattctcagcttatgaagataacgtgattaagagattaaagtaaaaacagacataagaaattataagatgattattagggaagtgacaaaagtccatgaaatcttcacaatttatgttcagagactgcagtaaagacaggcttaagaagttataaaggtattaattttgggaactgataaatgtccatgaaatcttcacaatttatgttcttctgcctcggctcctgctggtccctctgtttagggtccctgacttcctgcaacagttcagaaatccaggtcccatcacattgttggtagccagtggaaacccctaatacaagtgagtatctgaattctttttgagcagatctgtcttttgaactagtgctttcttcactgtatcatttgactcacttggtaactacatctgcagatgagctccccgctaatggagttttagtggtgctttacttagtgtaattgaataaatgaatgatacatcagctctgatgaagaacctttcattaaatagaaatatactcatagacctttgggaattcccaaattcatgaatatacttttgatgtatcatttactcagttgtctcttttgtaatagggagataacaatacctacttgacaggctggttctgaggattaaatgaggtcatatgttaaactggagcccgcatccacctctaggtcttactaggccagagaagccagtgttgagagagtcataggacaaagggcgaaaggtgaatgaatgaacattcctcttgtcccgaagtagctgatagtgtcatagaggaatcaagtaggtctgcttctgcgtaaagcagggttttatgaatcagggacagggagggacttagaagggagtactgcttgagcgattgtgggaaagtctgaggaactgtcttggagttagctctgggcttatatttttaatgtgagaatttactgtttagttaaaagcttgtttttatctcaaagaaaaacattgtttaatgtgtttgcttagaatttctttcttgacccagaaagaaatttctttattctcatagtgccaaagttagaaatcttgtatacaaatgttatgcacaacatgtgtttataaatgtaatccttaagatttttccatcatttcatctatggctgcatgaattttgttaatgtgtgggcctgtaggagggaccttatctttgtgtttagaatgggacgtctagaaagcacagttgtctatacctagtgtattgcaggtgagcgtttgactaaaatttaaaaatctgctgattagttcataaggcctctaatgtttttctataagcttgaataattgattttcattagaatggacactaattttcttagcttataaaactacatgaaatgttattctctgccagttgaaaaacgtaggtactggtatacctatgttgttatggtgggttttttttttttttttttttttggtcttttgaaggtcatccttttaaatgctggctgaatctttcagtgctatccttgtcatcaaatggaaatggaccttccccctgtaagtgtggtatcttcatgacagtcaagaaataggacttttgttttaggacatctccctgtcccaagtgaattaactagataactttgttgtatttaaatttcctggtttgtttgttttgtcttactaatgagacatacctacaggtcagatggaccataggtgctgatcctgagagttggaaaggaacttttcctaattaaaagcaaaacaaaaaaagccttacaatgcttatatttgcttggtgttcctattttccttcccttaagtagttttcatttctgtaaatgtgattcttattcattaggctatatcacataatagttctatttatcttttaaaatcttaagtatttatttttatatgtaatttaaacatttaagtacatagtactgtgaggtttattatgaaaaaccccagttctctttctcacagctgattactgctccctagcaaaagcccctttcatttcttttctgtgcttgtgggatttgattccatgcttgtatgcatacactactgtagcttgtttttttcattttagaccttctctattgatttcctacgctgcaagatgaaggttcatctcttatataaccctcctctcacacgcacaattctttatactaagctctcaataccattttctaattttcttaatattcattgtttatattttcatggctaaatattgcttacagctgagcatatgcagtgatttttatttctttgccagttcaaatttttcttttctctggagtcaacaattattttattggtttacatttcttagtaccagtcacaaattcaggcccccagtttctgataggactacagaactctgcagtcaacacctcactcatcctgaatcccagtaattttctgtgttggattctgagtcctggattacacattgtcttctctcttggcatgcctcctcattttgatggagcacatcctctagcagctttttgagaaagggtttacagggaggaaattctttgagagcttacgtgtctgaaaatgtctttatttgagcctcctacccaactgataggctagctatagaatgctagaatggaaatagttttcctttagaattgttacttttgagaagttacctttttttgagaagtctcaagtctttttaatttctctctctctccctccctctcccccctctttttccccattttcctatcctttcccccctacccattttttttagcacctttctttgtttctttttaaagtatctcattaccatctcttgatgaagcaccttggtttgggatttgccatctcagtttttggacgagacacagtctcttaggagggaacacgggaagtacccaccttacctggcttcacagtgaatccttacccctggccttgtttcgttacttagacctggctagcaggccctatgtcaccagagtctccgcaggccagagggcataaaaacacccagagactgtagtgggtatttatcaatcctggtgaggcctctccccacaggtagaatcatctgtagctgtgtacactcatgatgttggggaagtagctggcactacgtgccgtacatctgatggagggcatggtgtgtatcctgctttgtgtagtcgtgcccatatggtgattttggaatcctttgtgtagcctttaacgttgtctattattagcatgtttctgtcgtgactgccataggtggagcccacaacagtgcaggtgtttctttatcctttgagctgggcacctggtgggaactttcaatttggaaaatcatgtttctgacgccaggaaatttcttgtatgatttatttgataatatccaactcctgcctttccctacctttttttcctctcctgtttctgtactttaaaaagtctacaagtcagatattggggccattttggattgatgctctgatattcatctttttcctccttttgcccattcctttatccttgttggatttactgggagatctgctttctacattttctccttctcctcctcctcctcctcctccttcttcccctccttcccctctttcccctcttcctccttctcctcttcctcctcctcctcctcttcttctttttaaaagaaaaaaaaaaacaaaacagagatagggtctcactaatgttgcccaagttggtcttgaacttccagccttaagtgatcctcccacctcagcctcctgaagtgctgggattacaggtgagacccaccgtgcctggctattttttaatttttgtagagacagggtcttgctgtgtttcccaggctggtatttattctccaacccttctatagaatgtcttaattttacaattgtgtgttaatttccaagagcgctttctcattcttggatgtttatttttattagcgtcctctcctagctgctggtgggttgctggcagcctttggcgttccttggcttgcagatgcatcaccccaatctctgcctttatattcacatggcgttcttctgtgtgcatgtctgtctctctgtccagatttcctcttttttttttttctttttgagacggagtttctctctgtcacccaggctggagtgcagtggcgtgatcttggctcactgcaagctccgcctcccgggccatgccattctcctgcctcagcctcctgagtagctgggactacaggcgcctgcaaccgcgcccggctaatttttttttttttttgtatttttagtagagacggggtttcaccatgttagccagaatggtctcgatctcctgacctcgtgatccgcccgctttggcctcccagagtgctgggattacaggcgtgggccacggcgcctggaccagatttcctctttttataaggacatcagtcctactggattagggccagccttaatgacctcgttttaacttgaatacctctgtaaagatcccctttccaaataaggtcacattctgagctaccagaggttaggagttcagcgtttcttttttggaggatatacttcaacccaaacagtgggttttgagagtggggataacacatgtgacatcctctgggtttaacaggatgtctagttagagcaatatttttaaagatgcttttagttacacctatcttcactaatgatcagaaagaaactcttaggaagtaatttttagattacaactggagatttttgttcagacttgtgactgccaaaatttctgcatgttcctgaatgtttaatgacagtatctgagttgtctcattttcactcttggtttgtttctaaagtcatttgaaggttggcaaaatgactaaagaaagaacagcagtagtgtcttatgagaaagtaaaccgtatctatatcctggcatagtttcgtgaacatgttagccaggttctcatcatgctctgtccctccatgttatactctatttcttttttcagatatgagccttcttggagctttgttgcttaaaaaaaaatctgtcatgtattttcctgttctgggctctacaacgcttttctttccttaaaagtggctcttcctgctcttcctccctctcttcagggagcagcaccctcttttatttcctttataatagttgtcccagcctaacatatgttgttgttgttgttttctccctccccacattagaatataaccactacaagggcaggtaccttgtcagccaagttcactgcttgatccccagctctcagaatagaatagacactgctgttgagcagatcagtgagtgaaagaggccttgttttctgactttcaagtgctgtttcgctgacttgctgttgctcttggaagtccttctctcttgttgaagtagcttagtatgcaagtcagcttgtgataacacactggtgcagccttacttggcatttgttttgcaaaactacttaaaaatagcctaaatctgagtgattggtggcattgattgcagcagtgctgttggtatggccacagcctttccctttacccaagtgtcctcccagagccaggaaagggaggtacctctccttacgtttctgaagattccattgtggtcccagtgggcaccatgcagaatttaataaagcagggcatgaaacttgagctgtgttttgattgacattgggaaagactcctctgcagaacacaggcacagggtgcctggagctgcctggcactggaaactctgcctcacggtcaccatgttctgtttaactgagacaaggagacacttcaggcacttccaaaggaaacagtagggaagtagtgaattcatgcttaccgatctagcagacttccctctgggaagctgggggactgcatccttgagagctaaaagcaagaaattggagatgtttgaaaaactaagtctgtggcatggggggtaaggaatcctcctgctacttctgtgacatcagctaagtaagctgatgaattggtgactttttgtttctttttgagttatactgcttttagtaattatggaagagcctgctctccccccacaggagtcattaaacaatgattgatgccatatgtaaggtttgtgaattgtttatgcagcagaagtcaccttttgatcagaattggggcactgtcttggtttcattgtggcacactgcagagttataggcatagtggcctggtactctgatgatgtcttgaaagtgactgctatagctttgacttcattaatgttcctttgaatttgttatgtttagaaaaatacaagcctctgccaggtgcagtggctcatgcttgtaatcccagcactttgggaggctgaggagggtggatcacatgaggtcaggagttcaagaccagcctggccaacagagtaaaaccccatctctactaaaaaaaaacaaaaaacaaaaatgagtccaggcacagtggctcaagcctgtaatcccagtactttgggacaccaaggccggcggatcacctgaggtcaggagtttgagaccagcctagccaacatggcaaaaccccgtttctactaaaaatacaaaaattagccaggcgtgggggtgggtacctgtaatcctagctactcgggaggctgaagcaggagaattgcttgaatccgggaggtggaggttgcaatgagccgagatcacgccaccgcactccagcctgggtgagggagtgagactctgtctcaaaagaaaaagaaaaatacaagcctccaaaaatgaaatgtacatatttatgatgtgttgattctggcacctcttatgcagaagtttaccattagcaaatatagcaaacttggtgccattggcaaggcctttgtagaaccaaatgatgctttatttggagatggtgggatgtgggtctgttattctgggatatatatgatactcaatagatagataaagatattggtcgagcgtggtggctcacgcctgtaatcccagcactttggaaggccgaggtgggtggatcatgacgtcaggagatcgagaccatcctggctaacacggtgaaaccccgtctctactaaaaatacaaaaaattagccaggcgtgatggtgggcacctgtagtcccagctactcgggaggctgaggcaggagaatggcatgaacctgggagccggagcttgcagtgagctgagatggcgccactgcactccagcctgggtgacagagagagactctgtctcaaaaaaaaaaaaaaaaaaaaaaaaaaaagatattttcctgggaggtaagcatgtagtcatatcttttctgcaacgtcaccatgcctgttgaaatggagaggttggatgatgtaattgatggacattataaaagaaccaatgtaacacttttatttttgggatgaagtcttgcactgtcaccaggctggactgcagtggtgcgatctcggctcactgcaacctcccactcccgggttcaagctattctcctgcctcagcctcccgagtagctgggattacaggcatgcaccaccacgctcagctaattttttgtattgttagtagagatggggtttcactgtgttgaccacgatggtctcaatctcctgacctcatgatccgcccgcctcggcctcccaaaatgctgggattataggtgtgagccacagcgcccggccgtaacattttattaataagtcttaagtttgtccatagagctaattacctctaattcttcagttttgtcctccgttatacacatgtaataaggaagcttggtaccctgcttaaaaaatgtgactgtgaaggaatatgaccagaaacttacacaatgaaatgtactttgcactttagggacagcatatacatttcatctatgctgtcattctggaaaacattttgaaacaccccttcctttttaaattgctttcagagtctcacagtgtatccttttatccccagcggtggaaaatctttacccttcaaggtagattaggtttttggaaatagccagaagccattcaaagcaacatctgatgaaccacgcatgtcagatgaatcatatttacttttggagtataagagttctgtgactatgtggtattgacactcatttttatcctgtgtggcacctaaattaaatttaaagatagttctttcaggaagaaaggggagccctcatgtcatgttacacagtggtgtatcagtggaattaatttattgtagccttcagaggtgattgatttaaaagacaatattcatactagagtgtagatgtgactaaacagttttacaccaaaacttggaagaagagaagacactggggacaaataggctgaagagtggggttcagttggatgagtcttaaggcatagggaaatggtttgggaagttaaaacatgcaaagagctgatgattgaagcatttagatttagaaagtcatttgttttcctttccagtgtccctcattattaaatagctccttgatggctagaatcctatcctaacagtcatctgctaagcacttactgtggcataggtcttggaactattcagttcatagttcttttttaatgagaagaaaaaagaaaactagcatttattaagcagctggtggtttccaggcaccacctcatgggatcctcacagcagtcctacctgacaggtgctctgaaccctgctatatgaagggggcctgtgaagcttaggttgacctgaaactgaagaaggttccatcctggaggtctgtatcaagtgggagagctgtggtataaaactccctgtctaaattcagccaagtcatgtgcttgccggcccacccctaacatgtttgtggggacccagtcagaacaggcttatcaatacagggccatataccatctgtttaaaccagtggttctcagctgcagacaattttgcccacacaccgcccccacccgccgccggggacattcagaaataaccggagacatttttttggctgtcaccactggggagggtgctactggcatctggtggttggaggccagggctgctacactcctcacctcccaagcaaagaattatctgaccaaaaatgtcaataggctgagaaaacctgtatctaaactattaaaagctgtaaatccaaagaaaagataaatgttcgaggggatggatatcccatttaccctgatttgagcattacacattgtatacatgtataaaatattattatatgtcctccccaactatgatatatcattaaaaaatttttttaaagctataaatccagtcaccacccccatggcccggcctccatggccaccagtggccctgcagaagccttgtcctttgccagctgccctagggagcctgaccataggtctgctgcacacatctacactgaccagggcacaggtctggggcagcttggcttgtgataaccacctgttcctttagctaaattgtcttcaaaaaactttcctagaggtctgaaatgaagaagaaaaacacttactgcctttgtattttgggtttatgatacacagagccttctaaagtgcaggacccaggactaaaggcagtattggtacctgagatattacaggcactgggcaagttcttgaatgataggcgtacatttatgtacagtctgtactgcttcattttaagggctgttactgtgtggtgtaaggctagattgagcatgttttaactactttggctgggaagtaattgactttttcaatacctgtatgctctcatctttcaaatagcagtgtggtttagaaccagaggttttttacttggggtctgcagactaaccatagaggggttccatcggatcctcagagcacaaatctgtgtatggttgtgtcggtatacatgtatgctgctggtttgcatgttttctgtaaagagggtatattgcaaagcttagttgggttctcagaaatgagaatggcacaaactactcatgggctatatatattctctagggttacttctagatgtttagaagctaagattaggaatttgtgttgagatcagaagtggatttgttgtggtccagtgtaatttttgactgaaggaagaagctctctgttgtgtgtaggtatacataaaatgaaagttacacgttaactttttgttgaagttattgctgtggaatcaccaagctcgtggtaaaaactaagttgtgggaaatactttgctttctacttagtagagttgaatgctcagaaagccatagttttcgaaatgtcagattgttttacctagaaggatacatagaaattatctagaaattcactttttgggtgaggaaattgagggttaatgatattcagtgagttgttcaaataacctaggaagtttgtaacagtataggaatagaagatgatatttatagccaagaacaaatatattctcattttaaactatggactgtattgacattgctttacatttcaattagagttttattgcataattttaattcctatttttcttctcctaccttttttctttcttctttcttcttctttcttctttgttcctttctcctttcttcttttttccttcttcctttcttctttcttttttcttcctccgtcagggtctcgctctgtttcccaggctggagcgcagtggtgcaatcatggcttactgcacactcaagctcctgagctcaagccatcctcccacctcagcctctgagtactacagatgtacaccaccacacctggctaatatttaaatttttttttttttttttttttgagacgggtctcactggctggagtgcagtggtgctatctcagctcactgcaagctccgccttccaggttcacgccattctcctgcctcagcctcccgagtagctgggactacaggcgcccgccaccaggcctggctaatttttttttgtatttttagtagagacatggtttcactgtgttagccaggacggtctccatctcctgacctcatgatctgcccgcctcgacctcccaaagtgctgggattacaggcatgagccaccgcacccggcctaaagattttttatagagatgagatctcactactgtattgcccaggctggtcttgaactcctggaactcaagatctgcccaccttggcctcccaaagtgttgggattacaggtgtgagccactgtgcctggccccattgcataattttctaattgtagtaagattcaaccatttttgaatgtatgatttcatggtattaactaccatttactatgttgtacaaccatcactgctatttccaaaatttttcatgactctaaactctgtaaccattaagcaataactctccatttcctccacctggtaacctctaatctaccttttatttatgaatttgcctattctagatatttcacataattggaatcatatgacatttgtccttttgtgtcaggcttatttcctttagcatgttttcagggttcgtccatgttgtggcatgtatcagaacttcacttgttttcatgactgaatgatattccattgtatgaatataacacattttgtttctccatctgttgatggacagttgtgttgtttccacattttggctgttgtgaataatgctgccgtgaacactggtatacaaatgtctgttttcagttcttttgtgtatgtacctgggagtgaaattgctggattatatggcaattctatatttattttttattgtattatacttttttttttttttgagatggagtctcactctgtcgcccaggctagagtgcagtggcgctatctcagctcactgcaacctctgcctcctgtgttcggcagttctctacctcagcctcccaagtagctgggattacaggtgcacgccaccacgcccagctaatttttgtatttttagtagagatggggtttcgccatcttggccaggctgatcttgaattcctgacctcatgatccacccacctccccctcccaaagtgctgagattataggcgtgagccactgtgcccggccttattattattattttttgagacaggccctcattctggtgctcaggttggagtgtagtgacatggtctcggctcactgcagcctcgacctcttaggctcaagcagtcctcccacctcagccttctcaggagctgtgattataggtgtacaacaccacacctggctcattttgtttatgttttgtagaaacagggtctcactatgttgcctacactggtctctaactcctgggctcacatgatcctcccaccttagtccgccccagtgtgagccactgtgccgagcctggtaattccatatttagcttttgagaaacgaccaaacttgttttctacagtggttacaccatttgacattctcaccaacagtgcacaagtgtttcagtttctccagttttctttctaacatatattttccttttttaaaaaaagttgacaattttattttcatatttcacaatatagataaaaactgcactttttttgtcccacttctccactccaaaatgattctttctttaataggaagggggagcaccttttctgtatcagactgataagaaaacacccagagtcacagcattgtgatctcctggtgaagcagagcaagcaatataaaactgatatagggaggcctcccctctatcctttctgtctgctcgagtcattctgggccaagtgggcaccatcatgggacaagcaagaggtctcatcattgggggcccaggcatcattggcatgtggcctcccatgggcagcctcattccaggagcaggtcccactggcatcatcccaggaggagggccccgtgtggggtgctggcatcataccaggatgaggaggacccagaagactggagggaggtagtatcattgtccctgccggcggggaacagagattgaagtaggaagtatctttccttgttgaagtgcaacccttattttgtcagtcaggctctgagcctgttcttccatccatttctaatagtaatctttgacattctgtctctgtttcctaccactgcaatatgtctttctcataaatggagagtcatggatgaggtgtgtgttgcagtagtcacggccattggccactctcttcctttttaacagaaactatagccatcgtagtgggtatgaattggtatctcattgtggttttgatttgcctttcccggatggttaatgatgttgagcatcttttcaagtatttatttgccattttgtatatcttctttgaagaagggtttatctagatcctttgcccatattttaattgaatcatttgtcttttagttgttgtaggaatttttaaatatattctagagttaaactccccaatttgcaaatattttcttacattctgtatgattctttttcttgatcatgtcctttgatacaaaaaaaagtacttttagtgaaatccaatttatctagtttttgttactcatgcttttggtgttatatctgagaatcatttgccaaatccaagatcatgaagatttaccctatgttttcttctaagagttttatggttttaggtcattaatccattttgagttaattttttaatatggtgtaaagtagggttccaacttcattcttttgcatatagaaacttagttgtgtcagcaccatccgttgagactattccttccgccatgcagtggatttggtactcttgtcaaatatcaattggccataaatgtttgggtttatttctggactctcaagtctattccattggtctgtatgtctgttttatgccagtactacaatgttttgattactgtaatttttttttttttttttgagacagagtctcactctgtcacccaggctggagtgcagtggtgcaatctcagctcactgcagcttccacctcctgggttcaagtgattctcctgcctcagcctcccgagtggctgggaccacaggagcctgccacacacctgcctaatttctgtattttttgtagaggcggggtttcactgtgttggccaagctggtctcgaactcctgacctcaagtgttctgcccgcattggcctcccaaagtgatgggattacaggcgtcagctactgcacccagcctgattactgtaactttgaaagttttgaaatcaagaaatggaagtcttccaacttagctctttttcagtattattttggctagtcagggccccttgtaactccatatgaatttgaggcttttggaattttgatagggattgccttgaatttgaagatcgctttaggtaatattggcatcttaacaatattgagtcttcctattcacgaacacggatgtctttctatttactgaggttatctttaattttttttttcagtgatttttgcaattttatttgtacaagctttcacctccttggttaaatttattcctaggcattttttttcttttagatgcattgcataatgtttgagattttagaaatacttagcatagtaaatctgaatttcagcttaaataatgagtctaagaaggtactgtggaagacatcttgagctctagctggtttgtccttggatatttaacataacctctctctaaacctccatttcttcatctgtaaaatatagggataaagcaaatctgtctttcatgagaattgtgtagatcagagataatatatgcaaaggattaattccagggtatggcttagagtaaatactaaataaatagtgcttggctgccaggattgtgttttcttctatgatttcaatataaatacctatgttgtacttgaagtatactttttcaaattgaatacaattaatttgttgcaaaggctgaagatttttacacaaactaaatgccctgttcctgagagagcttttttatattaaagtatgttgagtctggaagaaaaataaaatgaaatgtcacacttgttctgtttcaatggtgctttatccttagaagagggagcatttcttctcatgttgcaactttcagatgcctctttgctttttgaatcctatctgtgtcttgacattacaaggttaaatcttagacattaccagcatttaacttgaaagagtagcaaagctgactaacttttccccttttcttttactacttagtgcattgaggctttaccctcactggagattgcaattaccgtcaccatctggaattggattcatctgtatgtgtagaatataacttacatataaagctgagtatcagtgtttcaggttttctctttttcttacacatctcagtcaagctttagattgaagtaggcagattcactgagtgtaataatttaagaattcagttactttcattttaatttaaatttcaccaattaaataaaattcttcataacacttaagtatagcattagaatttctaaacattgtgaaactaaattctttattctcatagcaaagtatattagtcatttttgccgtttctcctgaagagcataaatgagcctgcattcaagaatatggaatgttgtacattctgatggggaaatagagtggcagaatatagtcaggttgaggagcatggaagtttgaaaaagaaccagaaatttggagagagagctgaccacagaaacaaaggagggttgccagattctgttggggacccatttaaggctacagataagtaatttatactgttacccatctggcctgctggcagcactcatgatgattcttttttttttttttttttttttttttgagacagtctctcactctgtcgcccaggctggagaacagtggtatgatcttggctcactgcaacctccgcctcagcctcctgagtagctgggattacaggcgtgagccaccacactcagctaattcttgtatttttagtagagatgaggtttcactgtgttggccaggctggtcttgaactcctgacctcaagtgatccaccctcctggattctaagtacacttaaaattacagcagccgttcgtttctatagatggaagaaggtggcaggaagaagagtaattactaagagtaatttactaagtaaagctgattacaaatatcttttaaataaaaaatttttaagtaattgaaagagatcacagcaacagaataatttaaacaaccatcaccagtttttcaggtggtcgagaaaatcttgaattagaactgttgtgaggaaccagctatggaagagaaaattggagtcaaagatggacctgaaatgtccacgtggaaaaaaataagtcaaggaatgtgaggatgaggggttcctacatgatgccgatacattttgtgataattttcacttatattttctttggattgtcttaatgatataatcaactcttgctcaccttatttgttgtttgttgctgtttttgggggacaagctttaagctatctcactttttgatctggagtataggaacccagcactggcttcttccagcaccttcacttggcctcagtgttgtgatgcactgagccacccctgttattgtgagtctataacaagtaatttgtttctgaaaagattaaagcactacactttgaaaattatttagtgttttaaaatttgatgatagtaagacttgcatttcaacaggattttttgagtttgaatgaaatgggggtgatataaccccagaacagaaaatcgtatacctaagggtgtcatcactgtgcaaactgctattcagaggtgaaatgggagaagaaaaagacatttaaacagaaacaattaggcaattaacaggccccctcttcacccccgacctccacccctgtcaagcaactgaggcctcaggagtcctgcctgagcagaacagagggttttccatttcttttggctttattttgttgaaaatgttgtccaaaagttgtgacacaagtcaggccataattactctgatcctaaattaggctgttcagctttactctcttaatgttcagatgcacttgactgctacagccaggcaactctcagtattgtctctcttgtctccaaatagtgggtaaaagcttgacctcaaacatttgtgttggaagggttagaccgcagaggttgtttggtcctaagctccttaaactgcgatgtgtacactgagcatcctctaattcttacagtaaatgtgttgcattaacctttgaacttggaagaagaaagctttggccagttagtctttcttttttttttttttttacattaaaaaaatagacttatcacaatagactacaaaatgtgtgaattttaaagataaatgacaagtcttcaaagaagtttatctttgggagagtcactttaagctgggcgtctgacctcaggagaccctcccttgttttttctcttctgttcctggaaagatctgtttgcatttggttattcactcacagttcagtgaaattgccagccactagctatcttgtttagaattttgagattatatgaggatattatgaaacactggaacttgagtaaactatataaccattacccaatgagcagttaaactacaaatgtttgaaaaacccaagagtggtagcaagaggaattttatcttggttttgaataaaacgtcagtccctttggggttgttttcataaacagtgaattataagtgattccatttaggagaagaaacacttcatatgctttggtgtagatggtgagagccatttggctctaaatgaaaacatttgtttcaggtgagccatggtcctttacatgttccctttgtcatgaggagtcttgaaaatgcagaaatgcacttaggttcttcactatagaggaattccggtgggtattatgaaattctttgtaattgaggttataaaatattttcatgattttttaataatcaaaacttagttttgtcacatcttcattggtaatccaggagcaaggtgttgtgtttccatagtatggccactgggggggagtacaattattttcatgttttatggtaaaataacatgcttgtggtgtaaaggtatttctgttgaaccagcttagtacagcttcagataagcaaattctagctagaaagttttaaataaatcgttataccctcttaaaaagccctgtatacctagtcttacatacttatgggattagtagtagaaaaaacaaaaacaaagaaggtatatattttacttagcatcattaaagctgtggaatctgaacaggattctgtttttcctaactagcattttagctttgtttccctaagttagactatttttttttgaaagagttaagtcttgggaaaaagacttccaaattctatgcactttttaaaaaaaagatcattgaagatgttatacaaaagtaaaaagtagcttttttcagtagtcatttatttttattttagcctgtagagaaaaagtttgacaatacagtagcgttttcctttgaaaatcatagggatgattaagaattgttggttgtgatttttaacatttatccatcaagactgaaaagtgccaccttgcagatggtgggggtggaagcagaactttggctaccagctttgaaggtcagggtgatccacaggtggccataggaggaaactttaggtgtgtgcctgttggcaacacagatgtttagaaaatgagctcacttctgatgggtccatagtacatgttccttgcagtcaggacattctgggagtcatcagctaaaacaaggaaacaatacaaacactatcaggaaacccccaaatgactggcttgggtgccccacctgttgtgtaagctgcattgtaggcaagagttgctgaacagaattctacccgctgacctctgccctgctggatctccaccacgcctcacttgctaagcctttgctcctacctcttgtcagcctcctcctgctgatccccagcatgttctttcttggtctctgcttggcataacacaaaaaagcactgaaccagaaactggggggcttcttctccctggcacctttgctgaccagttgagtgacattgggctaattgcctgacctctttctgggcctcagtttcctcacatttaaagtggatatggtttttgtctttcttctttccaccctccttacagttttccccttctcctgctatccagttgaatattttctcatctcttctacattttatttcctctgcccctctaacttttctttttttcaccttcttaggtttctctttaatctctctttctcctactagcctccccttcttgctgacctctggcttcttccatttttctccaccggcagcaccccaatatccggtttttatcactaccatctgatgccaaggatcctgaactgcagtagatcatggatgaagagatttaaatttttattcattgcataaaatttaggccagaaaaacctaaacaattctcttctggaagtaggagtttgtgtacatgatgtgtgttgaattagatcgcaagtgactgggcactttggtgtactgcaggtccacgatactatgctgggctagaaggcaagcaggaaaacatgctgcatgcaagataagttttgccatttctaattttggtgaaattggtttttaattctgccacttaatgtttttattatatgaaccttggtgatatgttactgtattaagcatcaccagacacctattacttggtcaaacatttgaaaattttgtcttttgtgaagtttagatgcagagaaaagggtttaatgtgaaggttaaatggatgtggatcagctagtatattgttgatgaattaactaaatactttaaaggaatgatgaacaatccagttgtcctcagttcttccttacctataacttgcctgaatggccttttccccaccttgttctcaagattgtctcggggccttagagcagcattgtccaatagaaatataatgtgagccacatgtgtaatttcaaattttctagtaatcacattttaaaaagtgggaaaaaaaaaactaggtaaaagtaaatgtaatttcttatttaactcagtatatccaaaatatcctttaaacatgtagtatatattagaaattatgagtttttttattctcttttcattcttagtcatggaaatccagtgtgtattttacacttggagcacattgcagttggtactggcctgattgccattgctcagtagccacacgtggctaatggctgtttgtgatgaacagcacaatcctagacaatggtatgaaaaaaacagtgtatcttaattcagaaatctaatatgtttgtccatgtgagttgtgtgtttgcggtttttagaaaaattcagttaaaattactatgttttgacttactgagagctgccaaggaaataccaggaatgttttaattttacagtgttgcattatcatattcttgaaattaataaattctgcttgttatatacagtactgagcaggatatctcccagaattgtgaaaataccttgggtcacaccagtctgacaaaggaaaagtgttcagtagttgggctcttggaggcatgtaatctggctgactttgggaagctccctgctgctcggaaaatgtctgtaaattacttcccttacatgattagcttatgtaagatcactctccatatgtgtagtagctgtttttatttctaaaaaatgaggatgtgattggtttagagaatcattaactcaatccctgtcctgtgtgatggaagctgcagtggccatcatgtgattgggcaggtcttggtgcctatcagtgtaaacacatggcacaacctgtcccatgcccctgcttatctcctttggggagaaggggttgaggtattttgagcaaatctcattggtaaacttgtgtatgcattgctttttttttttttaagaaccatttcctttcagttttagccatataactgtgtctgcaagcagtttgtactcagtttgtcaagagagcagctttctgtttggattatataccttcatctctgaaaaaagacatgctagttaaatttcaagatgttttacttagaagatgacaaggaagatgaggtggtttgtaaaggctcattaagtaaaactcaagatgtttaccatgacaagtcccctcctggtatcttggtgagttacatctcccaatgtccctgctcccttcgctgcttgctcaatctggacactactgagagacaaggggatggcatccaccaaaagaaaaagactaatgccctttcttaggaaaatgtaatgttgtagtgaattttattaacttctaagtgttatgttgaacagaaatctttggctacctgccctcctgcatttactatgccatctttctgctatctctattcgttgttatttaacaaaagacttttttttcctaggaaaaaaatgaagttgctgttttaaactgagaatttttaaaaattatgtttcaaaaataatatatttggtttcacattctctttgcatttaagtgtagtagtaaaaatcatataaaagtgttacagtttttgttggcctagtcataatttttggaatggtaaactaatattttgaagctgacgttgtatttggatatatgagagtggctgcagttgctttcttctgtgatcataaacaagaatttttgtaagcttgaagtatgtggggaaaatataaattgtatgaacttctttaatccagagttttctctcttgttacaaaatataacttagaacaagttatgtaagcttagtgtaagtcccagaaatctgcattaaagaaacaaaatcaagtgacttgaggacagtgtaactctacctgtggaagctttcctttaaaaataataggaaggaaacactattttcaaggttattttttaaaattaaggatggatatttttatgaaaacaagcataaaatcagtgagacaaaaattagtttctaaaatctgtggctcataacttgattttagttttaaggttatacaaatgtttattatctttaaaaatgttatcacactctgctttttgcttttggatctgttagtgaaagtgtacttactcagagttctcaggaactaatggaaagacgtggtttgaatatgaatggaagagtcaggtgctaccacgggggaggcagtttgcttttgaaatcaacattgtaatattatagaatgtatacacatattggctcactcacatttgttgtaaaggtcagaagggagaatagagaaccttgctgactttttacgaaatactttaaacattcatatattaagtagcactaacacacataaactctccctcacaggaagttcttaagacttgtgtctgctggtgttttccagaaagaggtcaagaggtgtttgcttaggctgcattttattaacggtcccattttatgttgccgttagaacattgaagtctaatgagtcacctccctgtcccatgagaagcatgagttttcttaatgctaacgtttgggataaggatctgatatctgcttagtagcctgtaatgattatataggagtttgactttataacctgggtgtgtgtggttagagggagaaccctggttttcagggtccaggccttctgtgacctgaacactccttacaaatcacatcctttctgggcaccccttttgtaaggtgacagtttcagttttgaaagagtctttcctcatggttttgtgatttgggaatataaatgtatcatatcatgatttggaaaaccatgagaagatttctgtgctttgttagaaattgggaaatttcaaagaccatgttttcatattttttgaaacaagtgaagacaatacctttatttgctaaggaaaaagctaaattattttatattcaaataacctgaagtcccagaataatctactggccatattttcaccccatttagggcagaatatactacaggagttcttagccaaacttgtaatcctcagaaatgcttatagaattggagcttttctgcagtttagagctggggggggactctagaggtcacctgaccattcttgttagagagaacccccggcacagagcccagacctcttctccagcggaagcgagacttgatcttgagtcttcacatcctcaccagcttcaggggactccaggaagccctgagggcagtgtccctcaattctcatctctgtgagctatttatcaaaggacatgggcacctctggttgatgccaaaaagctcaaccagatttaataacacaaacagtggtcagaggtggcaagtcaccctgtaggtggggcacatgatacgaggcagcgtgcatcatgctaagttaggaaaccttagtccacccaggatttggggtggggctgaggttggtggtggggaaccataacacgttgtcattactgattgctgcccagattcctagaacaactggaggtgaacaagtctaaaactaactgtgttcctccagtctagcatggccagtgttcaaaaaagtaattatttaattgagtggaattttatttcctcatagaaataatgttgctatgcctgtctcataattagccagagaactcaaccagagttctgagtcctagaacaagggggaagaagggctaatgcaagaatttcctctttctttctggataagggccaagtttcgctaaaatttttgagacaaacattttctgagttccattttcaagccatgttttagctcccactctccatagctagtaactttgggcttgaaaatgatacctttcctccctcctaactcccctaagttttaggagtgtttgtgctcttgccactgagctgtgaatgggtgatggttccttaagcgcagcagaagtagctgcattggaggaagaggattctagtaaacctacaggtgtgctttggtaggctcactagccaagtgacagtgtgcactgaaatgaaaactctgaggcctgctaagaggatatattgagggaccatacaagattactggttaggcagtttgggggagtaaattctctgaaagtctttgttttcaaagcatgctcgccacagatgaactcaggaatttgggggggagtagttttgggactgtggacatgaatatgtttcggctatttgaaaattatttattattcatttttatatttgtgcccccatctgttttcagtaaggaaggatttagaagtagtttacaattaaaacatacatgcacacagactgcctccacacacactgtatattgcatagctaagcctattaatgtagaggaaacaaaattgtcttcatttagcaaatatttattgtactacaactgagtccagtagatgcatgtaaatcaatttttttttgtttgcctccactaatatgtcggaattttttgctgctctgggtttatgaataacacagctgggcagatatccagcaaatggctgtatgaatgctaccatgttgagtttgcctggatacttggtcctgattacatactcagcatactcagtgcgttagagtgcctggtgagccctgttttgtagatgtgatccaggtgtagtcttcgtgcattgggaaaacacaccttagttacatcactgtgcctttaggtgtcccaaaaagtgaggctgctggcctggcctagaggagatggacacaactctgaaaggatctaaataaaaatctcagttgggcatggtggctcacacctgtaatcctgcactttgggaggcccaggcaggtagatcacttgaggccaggaagtgaggcaggaaaggaacaggaactactacaccacccttcttcagctctgttcactgtcaagaaaacaagagggtttgggagtcattccacctacctgtggtcctgaggcacagcttgagatgtgctacattctgggatcatttggaggctttcaaaagtacttgcagtagaatctgcagatggggtggcctgatcatgaggattccccaagcacctcagtgactgcaacgtgcaccgggggtgagaagtgagccccaaggacgatgatgcccacatctgactcatcactgagtgaatccctgtggagctttcaaaagaaaatacagatttcccagacagactgaagcagaattgaaggcagtagtggaggccaagaataactgttttgttttgttttgaaaatgaaactacagactttattcagattcttcttactaatgtcctttttctgttccagagcccaaccttaccttgaattgtcctgtctccttagtctcttccaatcgtgacagttctttagtctttgcttctcatgaccttgatgttttgatgagcactggtcagatattttgttgaatttgtctctacttcggtttgtctgatgttgtctcataattagattgaggttgtgtgtttttggtcaaaatacctcaaaagtccttttcagtgagtcataccaggagtccctgaggtcagtgtgtcttaagttttcccgatcacttgattatggtggtgtcttccaggtttctctactatagagttaaaattttttccttttgtaatgaatgtgtatcttggggaaaatactttgagaatatccagacatcttgtttatcttgtttctccttcaacttttttttttattttttattttttaaaagacagagtcttgctctgtcgcccaggctggagtgcagtggcgcagtcttggctcacttcagcctccgcctcctgacttcaagcagttctcctgcctcagcctcctgagtagctgggactacaggtgccaccactcccggcttctttttgtgtttttagtagagatggtttcatcatgttgatcaggctggtcttgaactcttgacctcaggtgatccaccttccttggcctcccaaagtgctgggattacaggtgtaaaccaccgagcccggcctctcctcaaactttgtcttctgtttttaacatccattgatggatcttgccttccataaataatactgtgatatattccaatagtgagtttctagtttcttcattttttcttcattaattataattcatctgtaagagctgtcatttctcacttatatattaatttattctatcagtgaggactcaagaatattttattcagctaattgtaatctagtaatcctgttttgttgctcagattgtcctgtgtttagctcttgggagtatactcctgttttttctctgacatacgtttgctcttttgattttgagcatttcccagtctctgactccacgagatgctccagcattatcttgtattttcctgcccacagccatggaatgaatcaaccacttttccaaggaaccctggttccttttattggagaatgatattcagaaagcaagatctgagccatagatatgcacattgttttgagagtatccttgattctaggtcctcttaacagagagttaggatatttgagtgtgttttctagctcaggtataaacacatcagtgcttgtgcatctagttacctgtgtatgtactttaaaaccatgggttcataccgagacctccaattccagtccagcaccacagggttcattttagcttcctctctaggaagttttatttttagaagctttcccaggtgtttatgattttttttttttttttgacaaggtctcactgccacccagtctggagtgcagtgtaggaggcaacctctgcctcccaggctcaagcagtcctttcgcctcagccttctaaggagctaggacctcaggtacgtgccaccacacctggctaatttttgtatttttttgtggagactgtgtttctccatgttgcccaggctggtcttgaactcctgggctcaagtgatctgcccaccttggcctcccaaagtgctgggaatacagacatgagccaccacacccagccccagctgtttgtgattaattagtcttggggaacgatgacttttggatgtatatctgtggatccaaaggctcttacggcttagttaagtactctttgttaatgaacagtctgttccatggtgaagtatcattttccataactgggttaatcatcatttcttcttatactaaaaagaatttttatgtcactcctagctagctctcattagtaaagtaagtcccctgttttgcgtgggaagtggtacagtttcatggccagtatgcttataaacatttgtcagagaaattgagcacacctcaggaaatgtttagtgggttgaatgcccagggaagctgttaaacattttaaaaaacatgtaaacaatccacgcagacaaatgacaggcttacgattccactaaaaccaaatttattttagtccttgagttatcttctttttgataaggcagcctacattcttttttccacgtgtagcttgctttctaaagcaggtgctctatcagacttcttgataagaaacccttcaaccccagttactgagagtactgactgtgaactttgggcctgcatgtgcttgttaatttagtagctgccaccttagctacaggagttgcaatggtagtccatctggctggttcttaccctcatttactaggatacaatatggtacaggttgagagaccttcaccccagggcattaacacaattaggacacgtaattacttgacattttaaacttccctaattgtgttaatgttaactgtgatattaactaaagttctttaatgggtgagagaggatgagatgggaaataagggggatgagcaaagtttaacatgtccttccctagacatagaacctatagtaatatattactttgtttccagtctggggctgtaatttggatagtggaagaatcgtacaaattcctgacttctaggtcagtgtgtaaatagaaaaaacttccgatagagttggagtgtttcaaagttggagtgtttgaattttggataaaattcaaaaaaattgtatcccaccaatgtcagtgatagtcaaccctgaaaatactgcacatggcttctatagcaacctgctgaaattgtgtgccttttgtatgtggaattaagccaaataatcagatttcctggcttattttagagttgcttatggttatcaatagtcgccaccaaaataggtttactacacaattcttttagaaggtttaggataaggacataccccttaaaacacacttttatgttcataacgtaatcgtatctgtaagactactcataataaaaggcttggctaggcgtggaatcccagcactttgggaggcagaggtgggtggatcacctgaggtgaggagttcgagaccagcttgaccaacatggagaaaccccgtcgctactaaaaatacaaaattagctgggcatggtggcacgcgcctgtagtcccggctactcgagaggctgaggcaggagaatcacttgaacccgggaggcagaagttgcagtgagctgagattgcaccattgcactccagcctgggcagcaagagtaaaactccatctcaaaaaaaaggcttaagatttttcatgtatggtagcatatggaagaatcatcatagccttctaaaagcctttatgaaattcctacccacacatagcctgaaaattccataaatttttaggagctgttttaggtttcagtgaaacaagaatgggtatttaagatggacataccagggcttttgtctggtcatgtctctgggtaactgctagactatagataagttgcttctctgggcctcagttttcttattagtacaatgaatataacatttacctcacctagttgtgaggattaaatcagatgaggtacgtaaaatggcatttggggtttaaacaatttttgtttgtttgtttgagtcaggatcttgctctgttgcctaggctggagtgcagtggcacaaacatggctcacactacagccttcactaccctggctcaggcattccctcccacctcagcctccggagtagctgggactacaggcatgcgccaccacacccaactactttttaaaaaaattctctgtagagatggagtctccttacattgcccaggctgctctccaccttctgggctcaactaattcttctgccttggcctcccagagtgctgggattacaagtgtgagccaacgcacgcagcctaaaatggcaattggaaggggtaagttagtgccctctccactttttcccccatcatctccctgtaactaacattaggaagaataatgagtaaaacatctgaattacagcttatgtaatttgttgaggatatacaatgtttaaaaagttaagaccatgagaaaatgaatttgaattttcaccagtatagaggtgaatttacattttaagcaaatcccacatgtgaaaatccaaacttaaaaaacagttacgttattttacaaaggaaggatttctctaataacaggctcccccaaggacactgaagattccttaaaaacaataccagtagaagcccaggcgcggtggctcacgcctgttaatcccagcactttgggagtctgaggcgggcggatcgcgaggtcaggagatcgagaccatcctggctaacacggtgaaaccccatctctactaaaaaatacaaaaaaattagctgggcgtggtggcaggcgcccgtaatcccagctactgaggaggctgaggaaggagaatggtgtgaacctgggaggcagattgcaccactgcactccagcctgggccacagagcaagactgcatctcaaaaaaacaaaacaaaacaacaacaacaactaaacaataccagtaaaatcaactttgtaaaaagatatcttagcaatcccgttttaaaatatccaaataaaatgaaattatgttcacacaaatgcctgtacacaaatgtttatagtacagaatgagcatccctaatccaaaaatctgaaatccaaaatgctctaaaatccaaaactctctgatgccacaagtggaaaattccacacttgccctggtgataggtcccagccaagatgcagttaaagctttgtttcgtgtgcaaaattaattgaaaatattttctataattaccttcagcctatgtgtttaaggtgtatatgaaacataaatgaattttatgtttggacttgggtcattatgtatatgcaaatattccaaaatctgaaaatatccaaaattcaaaacatttctggtcctgagcattttggataagggggatactcaacctgtagttttatttgtaattgccgaaacctggaaacaacccagatatcttctagctagtgaatggataaacatttgatacatccatgcagtggggtactacttaacagggaacagactactgatacatgcagcagtattgattaatgtcacgtggactgtgctaagctaaagaagccagaatccaaaggtacatactgtatggttctatttatatgatattccagagatggcaagactagggacagaaagcagatcagtgattggcatgggtggggaagagggattgactccagatgggtttgggcattttggagagcagtctgattgatctgtatcttgattatagtggtggctacagcaatgtgtggtcacagctaacaactgtacactacaaaagggttaattttcctgcctgtaaagtgtatgcttttttttttgttttaagaaaaatctattttgaatagttcaaggtacagctatttgtaatcttaaaacttcatagctaaattggcatgaacatttagctggaattttttctgtgctgataggtataaccattacacaaaggttaacttaagtaatagtttaatatctttcattattaattataaacagaatgttgaactgattacagttcttaatgattttacttattgcatttctctctatttgccagtcaggttaaatgttccctgtaacagcatctgtcacctcatgtacagaggtcaaaactgggcatattttagccttgatgggaacagacaagaattaaattatcagaaagtttcatgacaaggttttattttcattttgggaaatgaagggagaagcattaaagagaaatgtgggaacaggaaccatttagttttacagagctatgatagtttgaaacaagtttggccatgtgaatgttgtcggggctgaggaagggagttggggcccccttttgagggtgctgcttaccgttttaggatctccttaagccacacatgttattttgaaatttaacgataaaattgaacactagtttttcttgctctgtaccaggttctatttctgaagaaaattaatgttctggtacattattgagcacaggaaaattaaactattgtttccagccattttccttaaaggctgtgctctgtagcataattatattgggcattttcgtaaaagtcagctgactagtagaagatggataactttgtggttgtgtttcactttgttttctgtaataatgcagttacggcacccttgcccctgcctcggctgacttcacactgacttcctctgatgaccagcagtctctgccgcgagttgctgctgcgctgctcagtattctccagaatgatctacttggctgtcatttgttctcacggggatatttttagatttacccatcctgaggcggtgtcatttttgtcactgacatagactagatttatgcaagtttttctctgtgaggtcttcagcagcttctggaggaaagtattggtctgaacacatgggcattgcttttgggactttgggttaacttccaccatggatttcttttctttgtttttgtttttttgttttgttttgtttttgatatggagtttcactctgtcgcccaggctgtaatgcagtggcgcgatcttggctcactgcaacctccacctcctgggttcaagcgattctcgtgtctcggcctcctgagtagctgggattacaggtgcccaccaccatgcctggctaatttttgtgtttttagtagagagtttcaccatgttggccaggctggtctcaaacccctgacctcaggtgatccaccccccgcctcggcctcccaaagtgctgggattacagtcgtgagccaccgcacccagcctgttttttttttttttttccagtgcatggttatatgtatcttcacttacctcttgaattttactctaagtcagtgagataaaacgcaacactgtgtatatttctccctctccttgctgattctgttcactaggtcttgcattcattcattcatttattcattggtccattcattgatccaaaaccacttattaagaacctactattgctaggcactgtgccaagctttcaggaagcagtgaagcttgcgggacttttctcttccttaccggaactcaagagtttgaaggtagcctaaatgttcatgccgcgtggtgggtgctgtggtagggagagggcagggggccttgggcactcacagcaacagatcccatcttgtgacctctgctttcttctcagccgctgagcccacacatcctcccctatcatctttttgatctttgcctttgtgctctggggattcacaatctgttgtggatgtacgttcctttttgatcccacttcctccttacccagggaacctgaaacatccttgctcctcttacgaaataccagattaagatgaaaactggtattggcttttgaagaattgtccagaaaattattgggctgatgactggggtgggtagaagatgggggctggtaatttttgaagatgaaataggtgatgtttatggtccttccttaagttatacctgctgaaaagctgaagtagacactgtcgttgagtaaaggtctgggccgccactcggagagagggtgcattgctatactgggaaagcgtcttcccttttctgagccctactcagtccaacaaagcagttcatctgtttatagaaagtgagtgtgttgaaatcatcatagtgaagtgaactcagtgagcagaagtctgagctttcagattccctcaaaggaaataacatggtgacagatccaaaaatcctaatttaaaacttatcagccctgagaactaagcttaaggccagcttcatattttctcatttttaaaaaattaaaaatttttttctcaacagattaagttgttaagtagcataaagtgttatctgggttatgtttgaagcatgttcttgctagttttgccaggctgatatttgcaggagggtgttttagggctccaggtggctttatccagtcaggatctagcctgtctgatttaagtcctctgttggcaacattggaaatggactctgaacaaccacgcaaagaaacttatgactggctcatcgttcagagagatgccaagagggcaagagccagggccacctggggtgtcagtgttccaagctggtgggccttctgcatcccatctcaggtagcccagccctcccagtcttgggtggccttggctctccatatacgtttcatgaatatctgtttgggccagatgtttcccacccctgtcagccagcagataccaagacctgggtcccgtattatagacatggctactgggggcccacccttgtgtttcggtgcctctctgagcactgaaatcattgaaatccagggagccctgtttttaccttcagatctagccattgcattatgtgtctgtttaaattcccaaacagaaatattgaatcagaaaatcccctcttcttacgtatcccaaaggttgatattgagtaatatttggttgtaattgtggaaggggtccttaggcaagcagtcttcccaggccagaatttctgagttttttcacagaagcactgccagttctagaatttaagtatcataaaacagtcaggtcagctgtcattaaaatgtctaaaattctattactatctattgcttccacttctgatccacacttatcagaccttgacatctttatacgacaggatgtgaacttgagcccataacaacttagtcttcataacaaacttaatcaggcttaagaggagaaagttcttgcaacagagcctagagttagttcccaaacttgggtgtctgtcagaatcgtgggtaacagatttttaagacctcatttccagctttttatgtagtaggtctgggttggggttcatgagcgtgtatttgtttttatccccctttcccgtatttttcatgaatgaacctacattcttaagcaccaaaacttgcttctattgcaggcagtccaaggaccactctttgagaaatactgacctagagtgtgctccttgccagttttcctcatttagtggggaaaaagaagttagatataaaaacctccctgactgcgacttcaaacagtggaggtgatggggttgctctgatttagaaagacagagtttgtgatctacggggaattgactagaacctcagatcctccaaagcacacctcatcctggctaaatctcattctctcaggagggagtcctctgaggcccaacaccagctcagaacgattcaaaaactcccctgtactttttctctgtaaaagacaaaggacaggacaattcccaaggctcagagcctttgtgtagtcagttttctgttgaactgattttggaagtagcacaaagtagcaagagctcttacttttacatggaactatgcttccctaacctggctcatcttcataattagttcttaagctttaaaacagtcagaaatttgcattttttaaaaccacccagaatgattttcatgtacacaaacttttgaagcagtgtggtagtaagtagtgttctttaagttcaaccttgataggaagttccccaccaggtctactctttttatttccatatctctaagttggttcatgcaacagtcatcaagactaactgattctcagctccctgtgtgtgtctcttctaccatagagctgtgcagtctcttgcctgaatttgttgtggtgacttctggagtagtctctctgcctttagctacctcttctctagttcatcctccccctgtgacctaatcctgtcgcttccctgaacagaagaagcactgattgcacccattgcccacatgataaacttgcacagggtcaaaggccttgtggcatctcactcttgtccctcaaacttagcacactttcccataagctgttctctctgcctgggactgcccactgggaaccttccttccttaatctgttcagccctttacacatacttgcacttctagaacaaatattttctgctgcttgaagccttacctaactctcccaagtagattttttctctttttgttctctagtcttcctaacagtctcccaaatagcattatcataagggattatataagacagtatttgttatatctctttcaagaaccaaggtcctctgagagaggatgagggcagaattttgtttatcttcataaggacttactgtagtgactggcatgaaataggtgcttaattttgactgtgtgaaaactgaactgtaccagaaacaggccagtataatgggcatctttttttgtgattgtttctgagttaaacctgtaggaggattacatcgagaggcctttcccgggtaaggcttcttccagatttcctttttcattgtgatgaaaaagctgtctggatactcggtgtattcaggaagtttgctgggaggcactgggttttcgtttacagagtctgtacagggactaaatcgtcctagaaatgaaggagaacactttgaccagtcgccctacactgctggggcagcaggagacccgctgtgttcttgaggagacatttggggctctttctccactgaaggtctaggagcggtgagtgttagaggctcagctgtcagcacttctcatgggccatcttagcttcaggaagaccgcatgggctttaatgaaccatctgttttgtgctcctggggggtaggccaggttgttcttgtgcggctgctattttctatttcttgttttataaagtgagaatttaaagatagctaatataaaataatacaaaactaaagaaacaaattggcattctactatgacggggaaaagaaataaccaggaagtacaaagtaaggcatttgcttgaatttaaatgtctgagaacagcttccctcggaaaggctggattccccgtcagggcttggcgtcgggagtctgtggccctgctttcaacttaccctagactgcgctgtgttgtatactcttcctttcttctgtctagctaagttgtaacctcctttcgttctttgtaatcccttagcatctggtgggcacactgtaaatgttttgtaaaatgttgactcagttaagcacctacacgatgtgggcaagcccctgggggactgtcaccccctgccctccctgaccggggagaagcttgcggcagctgctgcgtgggtacctttgcgtttcatcacttacttttggggggaagtttttaccatccagaatcccccccagattcatattggccacctctaggttactctgggattctttgagaaaaccatagggatttagtataacctgagttcagccctcagattttttttgccctcagggacaccacatgaccttgagacccaatgatttaagccatgggtcagaggtagtggagaaagttgggaccctgagtataggtagaactgggttctagtgaatagtagacacctcttatctcaatctcaaatttaaaatgaaattaataatgcctgctagcataacccacattctctttttgaaaatcaaatgaggtatgtttgaggaagttcttgaaaaatattacatgctaatcaaatgcaaaccgtaatcatgggtgtcctgaaggagtttggtccaggagcacaggggcaagctggaatgtttacctacatcctaggtaacagtgtcctgttgtctatttcctgaagcatctggtgtctctcttccctcctagcatactcctcatgtccatgagcagaaagttagctgcaatggcatgttctttggtaaaagctgttttaacctctgtccgtaagcctcatgacatgtggcgctcccaggagtctgctttgtaacactggaccatggtccagcgggagggttaatagtagtggtgtgaggagacttggagggtaagtatggcttctttggattccctgtaatcatttcatctttaagtagtcaagtcgcattaagtaaaaatgatactcagattgctgaaagcagcccacttgcagtaagaaatctggaggcttcatgaaggcttttatcatgtttacttagagcatttctgttacttagagatgcaattaagggcttaggttctaggctcatacttgagtttgaatattaactctgccacttaatagtgtgctgaccttggatatttctgaacccgagtttccacatataaatgggaataccaaatccatgggtatctgtgaagactacatgagataacatacaggttaacatagcacttgacacatgagagacgtgtaacaagtttagttgtgtgttcgttggtagtagtactaacaatactagtaccgattagatatttggagataaacttaagaaacagattttgaaacacttaaaatagtggtttagaatgtatccattttgaggccagtcgtggtggctcacacttgtaatctcaacatttcgggaagccaaggcaggtggattgcttgagcccaggagttcaagaccaacctgggcaacatggcaaaaccccgtctctacaaaaaaatacaagaattagctgggcatggtagcacattcctgtagtcccagcttctccggaggccaaggtgggagcatcgcttgagcccaggaggctgaggttacagtgagcagagatcgcaccattgcagtccagcctgggcaacacagtgaaaccctgtctcaaaatgaaaataaaagtaaatagaatgtgtccattttgtgctgataatttatgaattttttttattgtttttaaactaccttttatctctgattactcttttccttaacaaaagttatttttgattgaacacatcaaataattgaaataattttaagcagtttttgtaggagggggattggtatttgaacctatttactgatgcttttttttttttttttttgagattgggagtctcactctgtcacccaggctggagtgcagtggcacgatctcagctcactgcaacctctgcctcccgggttcaagcgattctcctgcctcagcctcccgagtagctggggctacaggcatgtgtcacgatacaggccaatttttttgtatttttagtagagatggggtttcaccatattggccaggctggtcttgaactcctgacctcaagtgatctacctgcctcggcctcccaaagtgctgggattacaggcgtgagccaccgcgcctggcccattttatttataaatccatactccatatagtgattattcattttagtttctttgatgctcagcaaaagatgctaagctgatcttcaaacttttggtgaataacgaaatcttgaaagctaccattcattccagtgtgtgtccttttataccttaaaatatttgataagaaaaatatgatagtgggcactgtcaaattttatgcatgaaggactaatttggcgtattgaattttatatgcgaagggccatttggtctctaataagtattgtagttgcttattttctactgcttttttttttcttcacttttttatttgagtaatcaataagtacttcttttccttcggagctcccaatacttaatctagcccatgggaaggtacctaggcctaaacagcacactgtatattacatacactgtgtagcagtcaggccacatctgagccattgtgtctagctgtctttaaatatcgtttttaaagatggacataaataattgtcataagagtcagagtagacccaatcagttcacatattttaaggaacaagaatgcttagcctagaatagaagagactctgataaattctttggtgtgttgtggtttcatttggaagagcgtggtaatattcagtgtgatttctagtggacataatagttctctgacatttttatggacttcttggtaaagtagtgagtctctgtcaactgtaacgatcccaaaactgaaatgcagcatagcatgcgatgtttaagaagagacttgtcttagtcagcttggggtactgcagcagaataccatagatggtatttggcttaaacaacagacatttatttcttaccattctcacagatcaaagtgccagccgattgggctctcttcctggtttgcagacttcttgctgtattctcacgaggaaaggaaagagagcgtggtctgggtctctttctcctcttagaaggacactaatccatcacatggaggctccacccatgtgacctcatctaaacctaattacttcccaaaggccctgtctccaaataccatcacattgggcgtcagggcttcaatatatgaatttggtggtggtgggggacagagggaggtcatagatattacttaacttttctaaccctcatttctttttttttttttttttttttttgagacggagtcttgctctgtcacccaggcttgagtgcagtggtgtgatctcggctcactgcaccctccgcttcccaggttcaagtgattctcctgcctcagcctcccaagtagctgggactacaggcgcacgccatcacgcccggctaattttttgtatttttagtaaagacgggccttcaccgtgttggccaggctggtcttgaactcctgacttcaagtgatctgcttgcctcagcctctcagagtgctgggattacaggcgtgagccactacacccagccttaattgtctttaaaaatagaaataataccacctctaaagtagttctgagataataatgtataagtttaagaatttgggatgttacgagctttcaaaaaaagagttgtttccagtgtgattattgttagagtatttcagagatgtgttagaagcatttttggtatttgttaaaagaatgggctggatgtattcttcttgttccaagaatcagcaagtgcactttaatatttttatttatgcccgtaagcctcaagatagggatgctgctctgtgaccatttttcatttccacattttgctttttgtgtgggcatctccaaatgagcctgcctttctggttaaatattctgtctttgcttttgctcttttttctctgtgacttcttgtttgtttctttctgcatggctctcctttggtctctgtcactctccattatttattttgtcctcccacattttccctcatcattcatgataaaataggaggaatagtttatagtgtgttattttgctatattttttaaacatttgggttacatcattgtgtatcttttctgctgctggttcagagtgtggctttcccaggtgttgaccaggacaggtctgacttggttcttattgtgtagctatgctgggctagcatgtaggaataaggtatatggcactagattctgcttcaagagcaggctgtttaacatatccctcatgcctatgacgaacaactgcatttcctccagacgtaactaacggtgaggaagcctctttccccagctctgttggggtgacccttctagcagacagctgctcatcatacccagggtgtagcatgttaagctacaggcctccctttacttttgttttaccagccttcacaatataaatgtcattgtttcattatctgtcaagagaaaaccagttatttgacaacctgtatttttctacatttagcaactggcatttacacattaggttttcccatataacagcacatcccttaaccatggtagttaaaataatcttgaataggtacggttacacttaattatgaattttatgctgtagttgatggaagcttgttacacatttatgtttataagacttgtttgtggctgaatgtcaatgcttaaaagttagcatttttttgtttattttaagaaaaggtctaacatgttttttttttcttgtaataaaattcattttaacattgccaccaccattcaagcagtaataccaagattgactgcttggatgctgtttaattcatgtgtgtgccatgtaggtaaaaagcatgttgtgaatatgcattacctacagaatatgaaaaggatgcatgagatctagctgtgttattttttagaaccacatgtgaatctacagtgacctcaaaataggaatttaattattaaaaacataatgggatgttatatgaatattttgatgaaacactatttcctccccacactttttttttatgtttcttatttttttagtctcatttattactagttcatttgttcattcattcaataaatgattattgagcacttgatacatgcttaatttggtttagctattgaggtcaaatcaattattccaaaaccatcaccagattataattgtttgatatcacataaaggatgtcatcttattttgttatttaggagtaagttttgcagcacaagcgttttccagcttttctatgggtgcatttaagggccttggtaacattagttttaaaatattttaaaaatttcttccagggtaaaattatcatggcgatgcttcatggtgtagaactgatgggccttgattacacattcatccgcgtgtaggaacaggaaacaatttagaatcagggctctgccgtggccactcatctgtgaagagcagagtgaatttctgtgcaggcagatatcctggaggcccctgagttttcccaagaagacagcattctttctcccagttcagttttggactcacttggcaacacagaacatgatctctgaaacttttcagagcatggacctttaagctcaaggcagcctccaagctgggtgtagagaaaccacgagctgcttatggcagacagcctggagagcagtcagtcagtcctgtggttgggtgaaagttggcctctgaattagctggagcattggaggggctcttggttactctctgtcattccagtccccagaatggctttcactgaattgtgctttggcataatattaggggtgtcagcatctaatgaataaaatgtgggggtgtattcagtagctggaagtaaaatctgacattaggactgaagggggggatttggtttttattagtggaaaagttggggatggggccaaggcaataaagccacccctggctttagctgtacttcctctcctttgagcctttctggagaactccttgcagaccttttgattgtgatttgaatagtgaattgaggttgaggaacaagagtaaaacccttttctgtgctttgaactttgtagaacttgattgcatgttccagttagttatattgagtcattgaagggatttttccgtagaagtaatgttataaatgggctaggctcaggcagacttgccagagtttatttaatctagcatgtgtccgaaccatactattctggtaataatagttccttacaaaatgtagctctcactaatttattacattggttctgttggaagatgaatctctggtttctcccggggatgatgtttgttttttctgtttggctgctatggccaaagtggatgcagtagccgcaggttccaaagggtcttgggcaggaggtcagggttctttggtgattctgtgctgatcctgaactttggggaaaaagtccctaatggcagtcagtactatccaggttgctgagaaaggaaagggaatgcctcaggccctggctggagcagcctctcagatacaaaggagaatagtctcgggaggtccgtgtgtggaaatgcgtagaaacaatggtagcatgagactgttaggttgaaaattaataaggctaatgatatgaaatctggcatacaagtgagtagtgtcatttttgttacgactgttatttctttgtcaatagatcacaaatttagtgttaacatctcatctaatttttgtttcttgtagtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtggtgagtgtcctcaaggagaggaaaagtcatcctgagattcaaagagaaagtgagtgagtgtcctcaaggagtagaaaagtcatcctctatgaataaatcgctattgtgagttttctaggcctttttttttttttaacctgaatgatgttgagacaatgttacgagaagtcaacctttatgtattgcttttgaagttactttgaaaaccacaaagctcgactgcagaagtctcttcaagggaaagggaaactgaaaattattataataatcttacatgttgcaactcagaaaagcaaaacagaaactagatgggggaacttagacatatttagaaaaagaaaaatttcctttaccttatatagtatttttaaatacttaggctaataccttcatactaattgtaaatggaataggtgggtataatcaagaacacacacacacacacacacacacacacacacacacacacacacatttttgagtcggagtctcgctttgctgtccaggctggagtacagcggtgtgatcttggctcactgcaacctccgcctcccaggttcaagcgattctcctgcctcagcctcccaagtgcctgggattacaggcacgtgcaaccatgcccccctaattttttgtatttttagtagagacggggtttcaccttgttggctaggctggtctcgaactcctgacctcaagtgatccaccggcttcggcctcggcctcccaaagttctgggattacaggtgtagagccaccgcacctggccatatttttttttttaaaggaaattaattaatgccacattttgtttgttttgacaaagctgtaaaaacttttgtaatctaaattctgttgttgataccaggacttgtccccatatttgactgaaatgctaaccaacagaccataggctggttgacttttgtttgttttagggaagattcattcaggaagaagatatttgtgtaggtttttcttatcctcttcaggttatggagcagctggaagttttgctagtatatctgatgtcaatcaaattagaaaacagagctagtaataacacttggcaggtacacagatttctctttctattcttgcctcgcagtatctacttaaataacatagaaaggctttgtcaacattttaaagcacaacaaaagagcctcaccattttctggcacagacctaaaagtatgtggtagaggaccactggtgtaagtcgaaaacatttattttcagctttttgctattttatatagctgagctttaaatagaaatttccctctatttaattaaacttaaatgttattttgagagtgaaagaaaatggatttcacaaaactagatattctttttctttttttcctccaggaaaaacatctcatttctaggtattacaaaatcagtttccactggagaaccacatttcagggtagcagggcttgtgtggtctggcctctgttcagagtcaccctttagaaagcaaaagcagttgcagtttacttagggacttagaaactttccattgcaaaacagtgttatttagccatagtttaggttctctgaaattttttctttctttgtggtaacaccaatagtactttcagactggacctgttctgggggaattggcaacaaactgaaatttcccattagttgtgtatggatctattgtaaaactgctgataaggtatcatcatcattattttttttttttgctgagattgttttttatcacattggatcagtgtctggcctttcaaaatggaacctgaaggcagatgtatttataagcatgtatgcatctgtaaatggtgaccaagtagataaaacaccttttcctgcttgctgtgtgcctctaatttaggaaataatacaattcctgtgcaaaagctacacaatcgttgtgttactatcttgtcaaaacgttgcatttttaataggaatgtactcatgagacacaggaaaagagaatttttttcctcctactcccttagtatctcagaaacccaaagaatatgtttgggaggaaatttggccatttgatttaccaaaacagctttcctgtgagaaaactgaaaaactgtgagagtaaaactgaaatcatgcctactttgagatacactggcaatttgcattaactatttgtcttattttaagtcagtttgggttagggaaagctggccattgatgtgaaagtaagaccccaaattttcaaatacgggtgtacctatgaagtgaatttgaaatcatgaccaccttaaaaccactgtttagagagatgtagtataataattttcccactgccattgatacgtaattgtttggtagaacagcagtactcccagtaaatttagtaacttaggagtttacttttagaaggtaaatgtgtacttgatattttaaaatttattgatatcagaaaaagctgattacttgattatttataaaagtttttttttcttttttctgttttttttttttgttgttttttttttttttttgagatggagtctcgctttgtcgcccaagctggagtgcagtggggcgatctctgctcactgcaacttccgcctccctgattcaagcgtttctcctgcctcagcctcccgagtagctgggattataggcgcgtgctaccacgcctggctgctttttgtgtttttagtagagatggggtttctccatgttggctaggattacctgatctcaggtaatccacccgccttggcctcccaaagtgctgggattacaggtgtgagccaccacgcctggtcagattatttatcaaagttaaataacccagtgtattaaaactattttcattgctgataacagaaatttaccctctactagcttaggcaaaaaagcttgctgtcagaattccctttttctttccccacctctgctctctgcttccacttctgttttctctctaatgtaaaatggccaccaatacctccaggctcacaatctgttaactcatcaatcccagtggagagagagcttcctacagaagtatcagtatttagtctccctgtcaaaggaacggacatatctctgggaccagtttctgtagctgggaaagagatatatttattggcttggacaacagcccacctctactccctaaagccacaccagaaatacaggttgagtatcccttatctgaaatgcttgggaccagagcattttggatttcatttttttcattttttggaatatttacactatacttactggttgagcatcccaaatctgaaaatctgacgtctgaagtgctccagtgagcattatctttgagtgtcatgtaaatgctcaagaagtttcagatttttgagcatttttagatttcagatttttggatttgagacactcagcttgtatatgatttgaaacaggatgaatagactcccaaaagacatttgagatattcttacccaaagagtggtaagctagttcaaaagtctagtacatcgactgtttctcagagataccagtttcatttcagcatcttagtcctatattatgttcagcacaattaagccacagtgtaagaagtaagactatatggaaatgaggggttatttttaaaactgttttactagaatttcatacatcaaattagtgtcctttttaaaataatcacgttggtgggaagaatttgttccaacttggtgttctctcaaaatatttttaaaacctttgtgttgttgttgcctgaagagttcacagcatattcttttaagtattgccaatattagcataatttgatgttaggtttaatttttggaaagaccaaactccatttaaagtcacacaaagatgataagtagtcacattgagaaatgtcatacttgatctctaaaagtaagggctgtgaagtgttaatttttctgagatagtgtatgaatagtttagagtctgaatttgcatgttaaagaagcattcttctattttcccagctacactgtttaaatggatagcctccaaaaatgaaattagttgctcagattgtcccagtttgactgttagtgtatgtccttcaagttgagttcctttgaaatgctcccatcagtttttgaacccttccttcctggtaccagaaggtgttccagaagaagctactttccctgcctcagctctggcattaattattttacgccagttccttttattgaagaatagtatttacgaacaaagatctgcttattaggcgtgctcgtaactcctgaggtatcattgcttctaggcagcccaagctggcagagccaggaaatgggtggatgtgtgcacgtgtacacacacacacacacacacacacacacacacacccctgcatctatatatgaaaatcatgagggcacacgggttcctccaattcccatccaccatcgcaggcttctttccccctccttatttataatttttttctctttcaacaggaaacatggttctgattatcgtcagtatatctgcttagttactcaatcctaggaaacacaaaatagtttcagaattgctaactcaaatctctgtgaatgtattaactactgcacaatgtttgtttggagtaacatatcaaatatgtctttagacttataatacaagtcaaaatactgtttccaaggtaaggttagttccattcttcctcacttcagtgtggttatgttattcatacataggaggtttttttgtttgtttttgttttgttttgtttgtttttctttttgagagagtttcgcttttgttgcccaggctggagtgcaatggcgtgatctcggctcactgcagcctccgcctcctgggttcaagcgattctcctgcctcagcctcccgagtagctgggattacaggcgggcgccaccatgcccagccgattttgtatttttggtagaggcggggtttcaccatgttggtcaggttggtctcgaactcttgacctcaggtgacctgcccaccttggtctcccaaagtactgggattacaagcatgagccactgcacccggcccatacataggagttttataacaagcattttgacaaaatatgttgataaggtttggatgtcccctccaagtctcatgttgaaatgtgaactccagtgttagaggtgagcctggtgggaggtgtttggatcatgggggcagatccctcatggatggcttagcaccatccacttggggatgaatgagtttttgctgagttgacaagatccaattgttttaaaagtgtgtggcacctttgtgtggcacccccagtctcttgcacctgctctcactatgtgacgtgtctgcccccacttcgcctttcaccgtgagtaaaggtttcctgagtcctccccagaaaccaagcagatgccaacgccgtgcttgtacagcctgcagaaccatgagccagttaaacctcttttctttataaattgcccagccttgtgtatttctttatagcaaacacaaaaatggcccaacgcatatgtctacctgaatttttttttgacatgatattacttatcccatcgtttcacctggttcttgggaaaatggaaccgccatcatcagtgaccaatcacagcactgattgtcacctgttacttacgtagtgatctgtgggcagaagagctgtcggtgaagttgtacttgatgcagttgctcacagctcacatactgaggttcctgaaacttgtgtgtatctgaaccgtgtgaggtgaggcctgcctgtgccataacttggaaagtgtgcaaatgtttgacaataatatttcccccattttaaatttgaaaaataattttaaaatttttatatgttgtaaaaatagatggtgaaacactttctttcaattcctggttgtccatctctccctctgccagctccatttggcttcttaggggttgggtaggggcaagtagcagtgtttctcagaggctgtagttctaggaacctcaaaactatgctaagtttgacttgagaactcagagttctggtttagtttaacttgaaggaaagactccttgaacattaagtcatactttgtttctcccatagattgatatagaaatcaacggcagtgcagtggatcttcacatgaagttgggtgataacggagaagctttctttgttgaggagactgaagaagaatatgtaagtttgcatgggttacaccctccttacacagtgtgctcaggcctctggtacgtggcccagacggaccgtttagcagttttttatggttgattgtacagaggactgttgttggcaagacaagctttagtttcatgttgaagaactaagctgtcaaaaaggaactgaagggatgaggaatttttctccatacaaagtttcagggtgcagggagcatgctgaatgcacatacttgcactttttctaagggaaggcacatcactttctagctttaatgagctttcttacttagtgttgcttctggttcacatattgacttgaatacattcagttctgcctgagtagggcatttctcttctggctatgtgtttatccacatgtgccctttggactgggactcatgtttaccattttggttgggatattacatccctcaccttgagtagtcaggtgaattaatttattatgatctcaagagagttaaattaattggcctatatccttttataagtgattacatgtttgacttcttctagcaaacgagcatgatttgttaaaatcccccctccccagcacacacattctgtatgtactgatttgaacgctagttaacgacggattcttgatggattcaatgtggatctttttatttatttatttattaataatagattttacattctcactaaagaactcagatcacgtaatgtgcatctttttaaaaattctttcaaaggcatcagtacatcattcttcataaagaataaagtctcaaatagcaaaactgataagcatcaagttattaaggatacaggactacttttttggctttgaagatgaacttacagtttgatacaataaatttacaaagaaaattattaccaaaaaatacgatagcaaaatgagattgtttatcattttttgattgagaaaccaacaacttaggtaccagtaggtaaagcagcattgaaacactatgatttatgaaggggaagcttgatcagactggtgctttttctagtttcttcattacttatctttgtaataccttgtttgcatttacttggcctaagcaacatttttccttatcagagacagaggcaaagagcagaatgaaacataataaatgacatctgtcaaaaaaaaaaaccactttttgtatgtttcttaaaattatttataattcataacactgaacttctagatcagcaggcaccgtaagcgagaggactgggttattgatgttaacctcgttttcatggcttattctgacagttccgctaaaaattatgctcagcaaggacaacttggaaaatgtcaactttccagcctttttctccctattccacatatgactacattgaccagagtttatcttgtgtagtatgcttctccttaaaataaaaaattgttaatttatccaacaaatgttggaattactactctatgccacatgctatgaatacaacatgcctctgttcctctaggggttcgtcatttagagtaggataaagatgaccaaaaacccagtttgttgccatttatttgatttttttctctcagatttttctcatttaattatatgtcatcaacattcttttcaagtctagttctaaacctaactctgtgcttttaatagctgcacagtattccatagtatggacataccatagtttgtttaaccattttcttgctggtaggcgttcaggttatcttcatcctacaaacattgctataatagaactaagaaataccaccagaaacaaaaagagctttcagtaagtaaaataaagatcattgaattaaaaatcctcaaagtcagagaccacgacctctcatctgggtttcttttggacattcagaatatcttattacaatttctctgtaagtgtgtgtttctggtgaacacagatttctcctagctaaatcaaactttagcttcagggtaatatgtttatcaaagctaagttcaaaagcttaataaaaaaataattacagaaacctatacattttcagaactattgtttaaaagcttgagtattttaaattatatgaggttaatttttttgttgtttgttttgagatggagtctcgctctgttgcccaggctggagtgcagtggcatgatctcggctcactacaacctccccctcaggtccaagcaattcttctgcctcagcctcctgagtagctgggattacaggcatgcatcaccaggcccagctaattttgtatttttagtagagacagggtttcaccatgttagccaggctggtctcaaactcctgacctcaggtgatccgcctgcctctgcctcccaaagtgctgggattgcaggcgtgagccaccacgttctgcctgaagttaatttttatctctattatgtaccttccatttcctctgatgatacaaaaaggaatgaaacaaatggctaagacatgaatttactgaacaccagacttgatcgtttatttagtattaggagtttgactgcttctaaatattgggccttattttcttcttttgaattcctacaggaaggaatatttcttatttttaaacataaatgctttatggtttaaaaatttactaatgtcatttgttacacggtattgtctctaattgcctttctccaattaatttggcaaaacataagcattggccgctctgtatcactgcatcctcgcgtcactcacctgtcctgctgccctttgtctgatgtagtgtccttaatctctgccttctgctttttcctgttctgaatgttctgtgtgagttcttgagagagtcctttgtaacacctcctgagatttttgttgctgctttgatctttgctttgtgaagaatttaataggcttagctttaattatggctttggggtgttccatgctgacttggcatgtcagttccttcagatggactcagttacatgtacccaagtgggctggtacttagctgcctcacaggggaaagacctcgtcagagtatagtaggcagtgccttagttcagtgggactttcttgcctttagggaatatgtattttttttttttttaccatggtgaaaatttatatattcaaaatattactgctttaattcactgtcgagtttgtcatggataacttttctttctccattctcctcaaggaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacggtaggactctcagcctgggaagggtcttgtgcgggtacctagagttcatgtgaagccaggagctgccagtttttttatggatacacagtgtgaggtttgggcttgttttccccctttacagtttattgtggaatcaagcagcaaaggcagtttctttgttcctttcaactattctataaatatgctactgaaatgtcatttgtagcagactggttgtgtttcttttcataaagaagtttccaggagccaaataagttctaagtcaaaagatctgaattagtgatttgcccctcggtgagcagatccagttggacaccatgtcatctctgggatttccctacccagtggccttaggcttggtatgtttttcctgaggagttgagttttgttttattggaattgaaaaggaatgatttttatttttttacatgagcagtcttgatcgctgcttatttacctgctctgtagaagagctcattatatgccatttttcatgtcagcaccgcttggggttgaaaggtagcagttgggagtagaacacgttttcttattcaagattccgttttcttccacctgttgcactcagtggccaccttggcactaggaccgtggtggggattctctttattggtgacgactggacaagaagctgctgcccatgagtggccctgcatttccagactctttatttgtggcgggagctgctggtccacttgtgtgttttcaccccatctgtcgaaaagaggtcacaccctacttcctggaaaacagtgatgttcaagtgtttttcatcctagaatagagggaaataatttctttcactagctatggaaaccaaatatatatcaagagtaaaccctagctcaatctggtatgtgttttatttgccaatcttttgttttaaatggtcaaaccaggaaaaaaatatgctttgttttgttttgttttttaattgagacaggttctccctgtgttgcccaggctggagtgcagtggtgcaatcatagctcactgtaacattgaactcccgaactcaagcagtcctcccacctcagcctcccaagtagctaggactgtatgtgcttacccctacacccagctagtttttaaaaattttctgtagagttgaggtcttgctatgttgcccaggctggtctcaaattcctggcctcaagcaactctcccgcctcagcctcccaaagtgctaagattacaggcatgaaccactgagcccagcaaaaagtgttaattaatgtagtattagtatattataattatactgcattaatgaataacatagtataatccttttttgtaaaacaattcattttccaaaattttgaaatctagattttaaatcttagaattaaacatctatatttgatagtaattttttacaattcgatattataagtaacatagccatttttaatacatgaaatttttttctactcctcttgttttattgctcactagctgtcatgtctgtggtgttctgtcttactcctcccacgctgaatatgtaacactttgatttcagttctgatagaatgcagaatttctccaatagaactaaacaacaaaagatggaaagcaatagtggaaaagtatgttaagctctacaaaccagagtacactatatttacaaaattttaaaatcctgaatgaatcaataaatttaggtaattttttttgtcagtgtcaaaatactagctgagaagagtttcatcataaatgttctgaactctacttttaaatatcattgattcccaaagaaatttaagctgataaaaagtaccagaatttcttaaaaagagactcttcctgtccttttccttccttcattcagtcttttaaaggttatttgtccttctcttcactaggagaataaagtatgagattttttacttttctactgcttgacttcaggaatattaaaaacattattaaaaggccgggcacggtagcccatgcctgtaatcccagcactttgggaggccaaggcgggaggatcacctgaggtcaggagttggagaccagcctggccaacatggtgaaactccatctctactaaaaatacagaaattagctgggtgtggtggcaggctaattactcaggaggctgaggcaggagaatcacttgaacctgggaggcggaggttacagtgagccaagatcacaccactgccctccagcccaggtgacagagcaagactctgtctttaaaaaaaaaaaaaaaattataaacaatttcctttaaaagttttgtcttatgcatactaaaatgtgtaggtgggcaagaaacgtattcttttgagaaaaacttgaaatgcttacacatcttaagttttattaggatcagccttgtaatgctcccagaagtgcttcgttcctgaaaatatttttaccaactaaaattcttccaagatctaccaaaaagagcactgaagtaatgcttttgtcttagaattttgttgacctgtgtcctttgtcagacataatagagcaacatttagaattcctgaacaacctacagcttgggaaattaaaacaatttctaaaacatatgccaagttccctactaaattgtacaagaatcattattctaaaggaatttgcaaacgaatgttgtaagccaattgcagaaatattagtacataccttgtttttcctgatggtgtgaaaggctgtatccactgtgtactgatgtgtttgacaggtatgaatggctgccagcctatctctaagccagcagcttgctggcttggtaagcaggcatgtcacaacacacgtaagctagggccttgcagtcgttttcaggaggttggtgttttgctttttctttaggttaccatggaataattgatgctgccacctggaggagctcttccatgaaatttccttaaaatagaatctgcttaaataatatagccaacagaaattaggactttaaaaaaagaaaacaaaatgtaaacatctgtgaaaattcaggttgttttctgaaataagcactgagctaaaaggtagacagactgggcccattatagattgtagaacagtagcctcttcatcgctcagggcgttggtttcttaatctataaagtgagagggtcgaaggggcctttaaaaggcccctttcagctcagcacctagactctgacattatttgagggaagctatttacggtcattaacagcatatgaaacaacgtgttcaaaatctaagagaaaaagaaaaggaaatcaattgcttttgcagttgtgaggactaggaattacgtggcgttgcggaatttgcagctttcctatagcatattctcctcagctcctaccacttagaaaagaaattatttttccagagaagataaatgcataaaataggtttctgttttgttttgacaaatggcatttcgtttaaattctttacttttcaagaattttgttgataatagaattaaggttaattgaggctccttgaaggaggcagatggaagagggaatcattctttaaagcagattgctatagcacagctggaagaaactcatttctggaaatcggagagctttaaactatacacggctttaaaaaactgtacctagtaagtctccctcccttcctaaagatgggcgttgggcttaaatataacatagaagccttgtttgtccttctagaggatggatggatgtctttgtgtgagagagagattaaaaacattgcacctaggcatatgtagccttttggagggaagagactctgcatattggatggtgttctagcataatcttgagtgcaaatatatgaaacatgccaccgatggaaatatttcaaatacccagcaatagcaaaaatggaggctcaatatcacaccatcagaaaggagtctcaacttttaatccactaaagcagacttacttaaaagtgatatctgggagctaaatccagggagcctaagacttttcacagatagcacctactgctctgatgatctgcatacttcatctcctgatcggtaattggcttctagagaaccctccatgttcttctggggtgagtgtagacactcagggtgacatggatcttacagatgctccctgccttttctctccttcgtttctgacacagaacacagagagaagtattgcagggctccatatgtcttacgggaaatgctctgtatccaaatgccagctgagatcattagccacgctgaaattcgttgactcgtactgtgctaaggttgctgctagacgttgttaacagagttagtggtctttggttatggtggttagcagccccacttatctgttccatactaccagtgaatagtttaaaattcatgttgcacctataatttatcccacataaataattcaggctatttattttggcattcaattgatttttttctcactttaaaaaactgaggtatggagactggtgctagcaacacgggattggctaacgcatcctcttgctgttcccggtgtttgggccttgcctgtgacagtgggaaaaaaaatggccttgctgtgctacaaccggagctgcggtcagcgcttcgatcctgagaccaattccgacgatgcttgcacatatcacccaggcgttccagtctttcacgatgcattaaagggttggtcttgctgtaagagaagaacaactgatttttctgatttcttaagcattgtaggctgtacaaaaggtagacataatagtgagaagccacctgagccagtcaaacctgaggtcaagactactgaggagaaggaactatctgaattaaaaccaaaatttcaggaacacattcaagcccctaagacagtagacgcgataaaaagaccaagcccagatgaaccaatgacaaatttggaattaaaaatatctgcctccctaaaacaagcacttgataaacttaaactgtcatcagggaatgaagaaaataagaaaagaagacaatgatgaaattaagattgggacctcatgtaagaatggagggtgttcaaagacatatcggggtctagagagtctagaagaagtctgtgtatatcattctggagtacctattttccatgaggggacgaaatactggagctgttgtagaagaaaaacttctgattttaatacattcttagaccaagagggctgtacaaaagagaaacatgtggactaaaaaagatgctgggaaaaaagttgttccatgtagacatgactggcatcagactggaggtgaagttaccatttcagtataggctaaaaattcacttccagaacttagtcgagtagaagcaaatagcacattgttagatgcgcatattgtatttgaaggagagaaggaatttgatcaaaatgtgaaattatggggtgtgattgatgtaaagcgaagttattaactatgactgcaacaaagattgaaatcactatgagaaaagctgaaccgatgcagtgggcaagccttgaactgcctgcagctaaaaagcaggaaaaacaaaaagacgacacagcagattgagtgggagatgggaggaaggctattacgtatttcagaatttttaatactgtgtgaagtggtggcttgctgctgtcatcttttgttttgttgttgtgttactgaatgtggcatttcagggttaacattaggttcttaaaagccaaagtcagtttatctttttgtgcctctcatctttctttcgtgttatgtaagattgattattcgtttctccctactggtaggaaccatagttgtgtcctgtacttgaagaggctgaaaaatagcccataaccataattgcagtatttctttgtatttctctgttaagcaaagaaatattaaggaactttttttatgtctttgtattattccataattagtaaagctaattgtgaatgtccaattttaatgaaatgtccaattttaatcagtttttttcatggatttgtgttcttacggtacttgaaaatatttaaggaagagatgaagctctgcagttttttctatgtgggatgattgcttttttaaggaggattaattctgaggtagtatagtaagtaaaggggaatatatgaattgttaacaaattaggatttgtttacaactacttgaatttttaaattatgtcaaaacttacattacttgccaagcagtatgatgtaagagtataggaaacataaataagaatacagaggtatcaatttgattaaaattcaccattttataagactaagcaataatcttaaaaacctctttcctgaatatttaaatgtgtttgtatggtgttatgactaattgttactgatttacagactaagccctcttaaaacctttagttaaatataaaaagaaattatatatatcttgcctccctgatggaaaactatgtaaaattgtagacttaaaaggtttgtggaggccgggcgcggtggctcatgcctgtaatcccagcactttgggaggccgaggcgggcagatcacgaggtcaggagatcgagaccatcctggctaacacggtgaaaccccgtctctactagaaatacaaaaattagctgggcgtagtggtgggtgcctgtagtcccagctactcaggaggctgaggcaggagaatggcgtgaacctaagaggcggagctggcagtgagctgagattgcgccactgcactccagcctgggcgacagagccagactccgactcaaaaaaaaaaaaaaaaaaaaaaaaaaaaaaaaaaaagtttgtggaaatacattaggatatcagaaaactaaatatatggagttgctttatgactattacatgttaaataaaatagcttgttttggagtttttttttttaaagtcatgaagagcttcacaattctagtgatacagtgttgattatatattgtgctttatttattttaaatataggtaacacagaattagatcgtttggataggttttgatgcagtgcagagcttaagaagaaaaattaggaaatattctgaaggccagaactctggaagaacttagaaagtttgggaataaattaaacttacatagatttaaaattaaaaggggtttatttcccaaaccccttgagtcttttcttttccttggcatttgcggaattcttacaaagaaaaatttacagaagtactattttcgttaataaagcatatatatcattctactaccattagcaaataacttagttgtagttaatataattgttaaaaggtttagctctgttacaaataaaaacaaaaagatctggcaaccagactcatgatgttacactaccatgacaagaaactctgggcagtgaaagttggacccacatggagtacataaacatctgatactgggagatgtatttaaaatttttcaagttatattccatgatttaggaaccatttagagacatgaagtctttatgggttgggggaaaggttgatacttagtttgattaaaggtaatgattaatatgcctttttgttaatacttctttctgaggctgtcttcccctaaacagtatcttaatctgttaaatgtaattgaaatattatttgaagcagtgagttattgtaacctcagattagttacattgatcaaaacattgatttatacacacacacacacacacacacacacacacgcagcttttatatttagtctggttacattagtgaccatggtatttcctttcttacttcttaaggagcctttgaatttcttgtccagataaaaatctgaataatatttatcttagactcatacataaagggacacagttaccgttaggtagcatatgttttactatcggtttgtcaaaaaagttaataaaaaatgcttattgatttgtttctctaaaaaacaaaacagaaaaaaaactgaggtataatttacatacagcaatattcacagaccgtaagtgtgcagttcagtgcattttggcagtcatatacatccatgtaacctccgttagcttttgaattggaaaaatgttaggcttagaaaatgatgcggaatttgaaagatgtgatgttgtagcacatctgtgagggctggagtgccctgttcacactggctgtgaacctcagcctccgagcccccagccctgactgaaagtcaccgtttacatcttttgctcagttctgatgtattagcaaaacagaatcagtgcttgtgctgttttcttcacattctactgtgtacgctccactatagcctcacgtcacgtgcttagtttgttactctgtcatggtttgccttgcaggtccctgttctaaggcatacctgccattttgaaagttcctaaaaggtttctggaatttctattttaataaaggaatcttaggactgaaagggatctcagcataaatcttttctgtcactgtagtgggcctagactaatgggctgtatttttgtcaggatatgaccaaaaaaggccacctcttgtcttcctggggctgtgaattcaggtggtacctgatcgctttttcaatattttactaaatcctgtttgctttgctgaattcttcttggcttaccttttatactgcagtgaaatatgtcccaaaagtaaaatatttgtaatataaaaattccggttagaaatttgtgtgacttttacattgttcttttcagaccactttcacgtatggatagtgatgggtcaagctgatgtgtcctttcagagtgggcaaataaagaccattcacaaacctgattttccctttctcaggggaaaatttgccttttgatattcctttattgagaaatagagtactttttcctagatgtctttctcaggtatatgttttctccccttcaatgagtggtatgccagagtaaggccctagagaaagaagaccagagttaggaaaaccttaaattaaaagattaagctatgtggaaaaactattacatgtcagagttagtggtaaataagagtatgttaagttaagatataaaggaagaagagtaatattaaaaaagaacctggttttctatccctgtgtttagtccagcaaactaagtgatgtggatattctcatttacatttattatctgtcctattagaacattgaattttctataagaagcctttaaacttgtataatatggcgctttatgctttgcagagttttgtttgtttttgggatggagtctctctctgtcacctaggctggagtgcagtggtgcgatctccgctcactgcaacctctgcctcctgggttcaagcagttctctgccttagcctcccaagtagctgggattacaggtgcccgccaccacacccggctaatttttgtatttttagtagagacagggtttcaccatcttggccaggctggtcttgaacccctgacctcgtgatccacccgcctcggccttccgaagtgctgggatgacaggcatgagccactgtacctggccagagtctttctttgtgcttttctttttacttttcagagatttcaacatgctacaccatgtaactctcacattgactctgaagtagacaggacaaatgataaatttccaagtaaagatgaaaacgggggcccacagtgcttctgagggatgttttcaaggttatatggcaaggtagttatagtaactgaaaatctgagaaaccaacaagtaaattgattaaaatcttatcagcagtagtgtaaccccctacccaaggtccttttatgaatcttaaaagcatttgtcatttttggtatcatcttcacatctccacatcttgtagattccaagtaaaggaaaccttctcagataatccttgggccaaacaaagaagaaaattagtcccaaggttttaagaggttagggtattgttaaaattttgagccatagatcttgtttgtcttcagctaatatacattttcaaatgtattcagtagaaaggggagagcagtggaaagaataagggcttacttgttttgaatccaactacttcctatctttttgactttgagcaagttactaaatttctctggatccttgattacttaaaatctacaatgaaatattacctcattttgtaaggattgaatgaaatagacataaagccttagttttcttttagcctttgaatcacccttaagggatggaaaaaagagaaatcacatttctcttttgtcctccccctatttattccatatgtgaatagtgattgtggtgttttatagtgggtggcattggtgtatccccccttctccttcatatattttagagagagttagtaatcatttgcccctcttcattttgattgtttgtagtatcagtaggtttgggggatattttaaagctgacaagaatgtcatcgttcctgcctttctttggtttctccttcacagaggatcttcaaatgcttccttgaaagaagaagaatgtaaagagcctttgctcttccattctggggatcattaccccttatctgatggagattggtcccctttagagacgtaagtatctttgaaatttcttggtttcttgaaagaggaaggagatgtattaattagcttttctgttaatctgtagtaatgatatttcccatttctctcacacagccaaggaactgaatgtttacttgtaacataaatatgaatcttttctctcaataattattttgtttctaaatttgatctgacttactctaacagtgttggccagttgtagatctgtataatcagcatggaatttagccatctacagttattttttttctttttctttttagtagagacaaggtctcgctctgttttcccagcctggagtgcagtggcacactcatagctcactgcagccttaaacccctgggctcgagtgatcctcccacctcagcctcctgagtgactgggactacaggcacgcaccactgtgctcagctaagttttaaatttttttgtagagacagagtctcgctattttgcccaggctattcttgaactcctggcctcaggtgatcctctcgccttggcctcccaaagcactgggattacagacatgagacattgtgcccactcatctgcaattcttaaaaattctcatcttttagtgtcaactgttggctgtaaatgaataatatagtgaaaaaaagtatagtcataactgtttattctgcaatcagattctcaggtgttatgttaatttgcctgcttttcctttcctacaaaattatcttctttctcattgatttcttgtgaaaagcaaatgagattatgaatctacagtgtttgtttacaaaggacctggtaagtcctcttaaatactagttggtgtcatttttattattattattaaagaactcaagtggaagaaataattgatgctcccttccatagagtttttatatatgcaggataaagtcaagatattcagatttgtttcttttaatctgtcaggctcagcaagactgaaggtttcccgactttcaagtcatcgtgtgtctttgttctctttgcagcacctatccccagacagcgtgtcctaagagtgattcagagctggaggtgaaacctgcggagagcctgctcagatcagagtctcacatggagtggacgtggggcggattcccagagtccaccaaggtactagggtttacttgcctgtggaaagtgtgttaatgattaaacaagtgacgaattcctctgcccataagtaaaggaggcaatttctgactgagctctcatgaatgtaaatgatagtgccctcatgtcataaaagtaaattcaaagttaacattttttgtaacatttggactatatatttgcaaccgaaggatttcagtagtattttgtgtatatttctatttactgaataataatgattgttaattattataaggacattttaaaaggcatcttaaactgaaattttcacactgaatttttattttttattttttggagacagagttcttgctctgtcacccatgctggagagcagtggtgcagccacaactcactgcagccttaacctcctgtgctcaggtaattctcccacaccagactttcaagtagctgagactgcaggtgtgtgctaccacacccagttaattttttagtttttattttttgtagagacaaggtctcgctatatcagcttggcctgatcgcaaactcctgggctcaagagatcctcctgccttggcctcccagagtgctgggattacaggcgtgagctgccatccccagccaacactgaaattttaaacaagaaattgttaaacctttttttccagctcataatgaaagaagaaagaactgagaagataaatttcttgagagagaaaatgtttagatcttctgttgaatttaggtttttaaaatatacattttgcatatatttgtgatcgaatttagacttgccacttttacactgttttaacagagccttgatgtggtccaaggagggtgaaattttcatttagttttctcccccaaaatgagtattttctacttcttagtaactgaaaattgtcagtttcctcagtcttctccagtataacttcacagtagaacatttaacgtacacctttttttttgagataaagtcttgctctgtcacctaggctggaatgcagtggtgccatctcggctcactgcaacctccatctcctgggttcaagaaattatcttgcctcagcctcccgagtagctgagattacaggcgcctgccaccatgcccggctaatttttgtatttttagtagagacagggtttcatcctgttggccaggctaatctcgaactcctgacctcaagtgatctgcccaccttggcctcccaaagtgctgggattataggcgtgagccactgtgcccggccagaacatttataagtatcatgatattgaacaaaaggcaattattagtttttctcactttattatggaatttttacatgtacaaactaagatacttaatgaatgtgttaagttaaaaatagaatgaacacattgccagcttaggaaatagattataacaaatactctgaaagtagtttaatttttaaacaatttaacttttttaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtaatcgtttgtttaatttggctccaggtactctcaaattagatggtaaattatttcagtgttccacataacgtgatggctgcctctgtatttgtattcaccagtcgaaacccgtcgcactttttttttttttttttttttttttttagctggagtttcgctcttgttacccaggctggagtgcaattgtgtgatctcggctaactgcaacttccgcctcccgggttcaagcaattctcctgcctcagccttctgagtagctggggttacaggcacacaccaccatccccggctgattttttgtatttttaatagagatggcatttcaccatgttggccaggctggtctcaaactcctgacctcaggtgatctgcccacctcggcctcccaaagtgctgggattacaggtgtgagccaccgtgcccaggcccgtcactcactttcttacaattgctttccatggcgtccccctggaaagtccagttggagcagggcctgacttgcacactgctgtctcttgactgttgctactcagtgggttcttgagaagcatttactgagaaaacaaataatgagttgtaatcaattgatgagtaaaattaaccactttattgataaggtatgtcagtaaagtgaagtagaatcttaaaaaattagaatagagaaaaaatgttttcacttgaaacatcttagctgaggctaaattaggtaggttttttagcagtaatatcagataaaaatcaatgcatactaattatgattatgagtatgtgctttcttttgctgattatttccctctaaaataggtagaaggctaggtgcagtggctcacacctgtaatcccagtacttaggaagctgaggtggacagatcacttgagctcaggatttcgagatcagcctgggcaacatagtgaaaccctgtctctatcaaacataaaaaactgagcctggcatggtggcgttcatctgtggtcccagctacttgggaggctgaggtgggaagatcgcttgagccctggggcagaggttgcaatgagccaagatgaagccactccattccagcctgggtgatagagtgagaccctgtctcaaaaataataagaaaaaataaaaattaccttaagaagttattctaatcacctgagcccagggaggtcacgactgcagtgagctgtgattgcaccactgcactctaacccatgtgacagagtgagaccctgtctcaaaataagtagagaaaacatccaactcttggttcaacagttcttcctcacttttggaacacaagtttaataaatcagaacatccttactatttgaaaataaaaagccaaccatcgatacttggtacagtgggtcagaacatacatattctgaactctggccttggatcctatttttaggaaagtgtgaaaccttctctaaaattacccaacatcatatatagccaattacctatttcaattaaaaaaaaattctagcaccaaagattaggtaattataaaccaacttaatatatattaggtatggaccttcaagttcactcagaaataatttatctaaaatgaaagaatgtgactgtcgaaggtgttggtggtcagataaaaccatctagcgaatggtggcttaacttggcacctgctcttccaccaaaggcctgtagccacttgttatgctctaagaaatgttaaggggggaaatccagttcttttaggatgaatgctttgtttttggaactaatgactcctgttcttagcacacagtgcaggatctgactagagacaggaaccctgagtggtttttactattcttttggcctcattctttttcccctctactttttattatacatttttgccctccctctctcctcaacccctctctccctacatctctccattcatccacatacagtgttttattaataaaacatttgaaaacaaattgcaggcatgacatttcactcttagatatgccaggatataccttctaagaatgtgaacattctctgcatagccccagtactattgtcatcttgaagaattcatgtttacatttccctaattgtaccaagaatatttttttagctggcctgtttcccaagccaaaattgcatcaggtttcacatgttgcatttgatttttatgtttcttgtaatcttttttattttagaactctctctcctacacccatccacaccctcatgccctctctacacccgtgatagtaaccttttaaagagctcagccagtgtcttctaggctctctcacgttctggatttgtctgattgtttttttgaaggtgacattcctatattttcttaactgggagttagctctagaacttactgtccactagaaatggaatatgaatcacatgtgtaattttgaatcatctcattgccacttttaaggaagtaaaataaggtgaaattaagtttagtgatatatttcatctaagccaataaatccaaaatataattttaatatgtaatcaatataaaattattaaggaagtatcttagtgtgttttacgcatttttaacattttgtgtacctcactttagcaacagtttaaatgctcagtagccacatgtggctggtggtcactagagtgggcagtacaggtctagaggcttagagttattgtttgaattgaagattagtttattgcatgtattgggtactcatattgtatctcatgatgaccactaatagtaatgctgaacgtgattattgtttaagatgttatctgccacatctatccattgtgaagtattttttgtccttttgtagttagaaggtaatgcagggtggatacttgggcaccatgtgaatatcctgtgcccagacaaccttgccttcatggttttagagtaatgccctcgttcccaatgcaggtggttgccttaagtttggtcatgcttgttcttagacctataaatacaaaaaagacttcaccattaaaatataaattatttaggggctagtattactcaattaacagcaaatgagagaatgagtaaaatcaaagtatatgtatggagcactgaacttctcttctattggcatggatggctgggaaccaacctaagtaaaaaggctggttgacacctttaaaattaaaaccctattcaaatcctgcttgtcactcttactgtttgcaaacgtgcgtgtgttttgcagagctgtaaatgaagaataactaaattcttacctctgattttttttttaaacaggtgttcacaaaagaagccaacaccagggacctgatgatatttaccttgatgacttaaagggtctagaacctgaagttgcagctctttatttccctaaaaggtagagtggtccttatttattgaaggacagctctgaaatagtctagttatttctagagtaaaacatttcatctcaggaaaaaggaacaagatgatggtgtcctttagctaaatctgatgatggcttcaggttttggaaaatttagaaatagcgcgtgtcttatttcaatatagtgacttgaaattaataattacttacgaagacattttcaatacaatgaggagagatatactagttaaacctacataagggtatatgacttctgattagcatttcctgtagtggttaatacaaactcaacatgcttgggaaaattttttagcatttattttattatgtgttttaaaagaaacacatctttatttgaaaatgttttccaaagaatgtgttcacttcttgggagtctgagatcctgagccttttctgaaccgggtctgggtctggtggggcactgcccccgcgccccgtgtccccacatcccctgcagctccacagctgccacccagcctccctcactgtcccgcaccattttccctttgaattacttcaaatatgggcctcaaatatgatacacttggactgccttcccaagttcatttctactcttaggggaattctgttaaactgctactctgtggttagaaaaaaacaacttttctccacggaaagtatgacttgaatatactgagccataggcacacataattaaacacttgtaaatgaattactgaaaagtatattttgttttttatttggaatagaaagatgggattgatataaagctatttaaattttttacaggtattttgggaaagttcttaaaactcctttctagctctgtcctaaatttatctcaacatatctacttcatttgaagtaatagttggatttttttaaggtgaaaaaactgaaacggctttattttaacagtaggaaagttcaaatataagctgtcatagaattaccacttttccccccacatttcccaggccttaatcatttatttatattggtattccttcggtatatgtcttagtttctcttttaaaaagtgaggagagtaactaaggtgatgataccttactccactctactgtaatttaactgttcacagtcactgtccatgcactaagtaagcttcttacctcattaactatttcttgaaacatttcataaatatttaaagatagtgagtgagactcttgtaatccatgtaagcattagtcatgtcatgatccttagcatcttcattaccaaatttacagtatttgtaattatcactaaactttaatataaatcacacacttttgtatttggtggcatcctgagtcagacggcatccccatgtgtgtagatgttgttgttactggttggggtaacactagctgctgtagaggtggaactcctgatctcgttggcctaccacgatggaattttgtttcttgcccctgtgaagaatgctctgtgttggtgtttagggggaggccttgcccacagggattcaggaacacaggctcctttcaccttgaggctctcccatccccatagggtctcagagtccagagtttactggcagcagagaaaggaatgagcatcgcataggagagggcccctggggaggggcaccatgtatgccttccgtccatattcacggctcagtcatgtgctcacgtggccccacctgactgcaagggggcctcgccgtgtgccccggagaaagaggagacaggtgtggtgaacacagaagggttggccttgcccctcactcccagtataacaacagttctgctgactttgtgtttccagtgagaacattctgtcagtccagttaatctcaattttgtgggtatgagtgtgcatggctattaagaggaaaaaatatccaaaaacctgaatttttttgttgattcaaatgggaaacaggttttgaaactgttacctagttaaaacataatctgtagtctgctgccacctactgctcaaagatgagatttgtttgaaagagccagtaaacctctgggtcactgtttttttaattcacataaaaatactggctttttgaataaaataagtgaatttgaaaattctcaatatctcaaatgtgacattaaatacctattcaaagggtatagagtagtaagcattggggactgtgagacttaaggtgctgtgccattcatgattattctttctcaaatttacacttcattgcataaggtttcccttgatcaccttctgaaacctggcttctgtgccttatcttgaaaaatgaaaatattcagtaacctcatctttagctcctggaataacagttacatccagtttatttctgaatacatttctttttctaggtgggtcttgcctctagagaatttgctcgtttaatttctccttccttctttgtgaggtaataggcgaacttagaaaagatttggttttaaagaatatagccttggactacagtaattttctacaggatgtataaagtgccacagctttttctaggacgttaggatcaaaggtttccaaacagcagattttcttaattaccctgtcattttcatcatggaaatgtaaataaatacttataactattttactcctttaattaaaaatcagaaaggccacagttgaaatgtttgcattattgtgaatgaccgtggtgattttgtgacgtatttactatattcacagttaatttctcactggtactatattaggttatctttcatgtcatttatgatatgattctaaaccctatctaagaaaagttatgcctgattgtaggtccatccgttctttttagcggatgtgttatttggtttgagcccccagagaaccatgcagtaaactaggaattcaaggagttgtaataaagcacatcttttccccatcccctgtccacagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaaggtacgttgggtgtttgtgccccatcttcatttcagagagcaatctggtcatcacttggttaaaacttaccgtgtagccatttcaggatatttacattctttagggatcttgtgcaggtaacaggtatgttctgtaatgtcagacccttataccctcacttaaggtcttaattgacacctctttatggagtggctttgaggtagtgtgcccttaaaggctctaatttcaaattaagaggttgggagttatcaggccgccctgttttctgagctgccagggtgcgatcatcacactgcaccagttttctcatctgtaaagttacagaaacatttgtggaactggggcccagctgcccttctggaaagcactgggccttagacatgaatatagggccctgaagttgtagaaaattgattgtccactgagtacgtggtctttctggcaaaaattaggaggattactttctgtataaggctggagggttggcctacgagagtaaagcttgctcaggaatcaggagggagtttagcagacatgtcaggatgcctataggctgggctgagtgccatgtgcatccgtcctcaattcatcagcatttttttttaaccttccttttaaaactgaactcttagtatttctcagtttggcctgtggcccctgtatgattttcttctaagggaaaattttctttccgtgactagtgtcatcttttgtcttccctctcccttagaggaactgaaggtgtgatgtggcagactgcatggccagaggctcaggaccatgtgttcctgaagtctttcctttccagggtcacaggaagctcattatgcctcttccctgtctcttcattgtttgtttgctttatattttgcaagaaatttaaagtgtgttatggccaatggttcattctagggactaagttaaataggtcacattctttctgtaatcctcttaaatgttcagtttaaaaaattatatgcgagggaatgcgaaatacaaaatgtaggtaaaatataaaagttacacctttgttttaaatattggtgacttagtctagtagagtttattggaagaggcagaaatgacaagtaaatgtaagtaatacacacattacctggagaaacaatccaagtgagcagtttctctgttagcctagatctaggagaatacaggtttaggaacagggtacaaaaattcatgggaagccctcattcactctgcaagaacttgggatttatttcacagaccttgagccaaattctaggtttttttgttttgccttgttttgtttttttaattctccaagcaattgtaacatgtaatttttgttgttgtttttattatttaagacagagccttgctctgtcacccaggctggagtgcagtggcaccatctcagctcactgcaacctccatctcctgggttcaagtgattgtcacgcctgcctcagcctcccaagtagctggaattacaggttggcaccaccatacccgccttatttttgtatttttagtagagatgggttttcaccgtattggccaggctagtccctaactcctgacctcaagtgatcggcccacatcggcctcccagagtgttggaattataggtgtgagccactgtgcctggcccaaacaattttaagatatgttttgatataatgtagcttgctaaagctgtaagacccctatgaatattccccagttatgccgttgcctgtcagtaaagtttcttcctctgagaatagaacttcgacagttttcgtgtgtgtgtgtctgtctgtctttctgtgtctgtcttccgtccctctctagccacatctgtatgtattttttttgaaagtctctgtcatgtccctttttactagtttgtttgttttcactgggagacagtggaaaaggagaatagaaaagaagtgttctttcttgtcctggggaaaaaaagcgtctgacattttgcttttgatgaatattcaaaaattagtttttttagacagatgattttagccttcaatttctgcaatgcagagagtattataatctcatatagggatttatgtaatctctaaccaaattgattattattttacattgcagaaaaattcatggagcatatcattacttatcacgaatttgcagaaaaccctggacttatagacaatcctaaccttgtaataaggatatataatcggtaaatactcctgcttttataattgttaaatactcttgcagtttttttacaagtgccatttttaactgttacttataaaagtgttccttcttataaaacttgtcatctcatataaattagccagtgggcaatgactttgaagtgaaagtaaagcttcaattttatttttaaaagaagcattgaaatgttactctgtttgatagattttacggcttctctgttcagagaagttgtgcttgaagcgaaggttattcatgtgacaaaaaattcagctgatcatctttattgaaaagaataagcaattttatatgtcacttccctcctccctccctccctgattccctcccctctctcttgctcactttcactgtgtaatggttttgcacaatttttgtttctcacagttactataactgggctttggcagctcccatgatccttagcttgcaagtattccagaagagcttgcctaaggtgaggcgatccaccatctgctgcctttccgaaagcatccgcagtgtctagtacttacacaaatccatatgtgcatatttctgaactgggtactattcaaagttttacttgagcttaatatttaatataaaagatcaaagtcatatgtacccactaaaaatatctcatgcccaaactctgggaaattagcagggctgccacttctttatttcatttttattagacataaatactagtttctgatggtctgtaaaagttgagagattttactaatcataagttaaatatggaatgaatgaaaaaaactttttctcccattaatatgggaagaagcagcaagaagaaggtgatgtagccaagagaagcttgacatcagtgtggttagggcagatggtggctaacatacctgttatatacaaactcacaattggtttttaatctgtcccccaagaagacatcatcagcctagttggtcctcttaactcatgagaaccacattttccaaagatagataaatgagatttgcccacctgtcagcccctaaggtcctacatagcagaccgcctggtctcatgccacagagctgtgctgccatgaaagcaggacggggtctgtctctcagaggtgttaaaaacgctagaggaatctgggaggtgtgaagagagcatcggtcacgttctcacattccatagtaaggccccgtccttcaggctagcatagaaggtaggtgctgtgtggccagtagattgcccagactaacccaggttggttgttttcaggccacagttgagtcctgggtgaaagacaagatgccaaagaaatctggtcgctggtggttttggcgaaagagagaaagcatgaccaaacaggtaacagacctagaggtcattgtttccgtgggctgaaagaaatgaatctttcatttattcaaaaaacctttttgtcaggcacaggaatttggactgtatagggctattttaccatatagcagtttccatttttgagcacttaggacgtgcaggtgttgtcccaagtggtcctttactgtagctcagcactagagatgttcgagttgccatttcacaggtaaggaaacttgggtgcttcacgaagtcacataactggtgagagacggagctggggcaagaccttgagtctgactccagagcctgtgctctttctgcttcactgtattacctatcagataggagcagaaggttatcgtctgcctgcatagttccagatgcaaataaccagaatctgttccaccaggtctccatagaaattcatccagagaaccatactaaacaagcagcagagcaagtctttttttccccaacaccttctgaaaaagagggttcagggagttctcacctgtttttcaaatgtcagaagggaagtcttgcctgaaccaagttcatgtccacgtcagcaagggggctgcctttcagtcccttctgcacgtggtgagttactcccaggaggagaaggaagctggggacctaacaagtttgggtcgcttgtattatgttttgtgacttgaaatggtgctcttaaaatgttttccttctgggtctgtagggacagtgatttgcatagaagcacatgacttctgtcttaggtttctaattctttggctcagaatagagaaagtctggtttttgagcatttttaagttgtgggttcagaaggcagttgtgttctttcctagagagggctgctgatgaacttggcttatctgtagggaaaaaattgcatgttgccattatcatcttgctgttacagctgccagaatccaaggagggaaaatctgaggcaccgccagccagtgacctgccatccagctccaaggagccggccggtgccaggtgggtgccctgtcctctgcccggctcatagcactcaggccctctagcagggccattacttctaagttgattttggcagcttgtttagttcttgggagtatcttctgcagatactacatgctgtgatatatttgtgccactcagcagatgacaactgcttttctaaaaaacatcaccagcttagaaaaataaataccctgcctccttgtggagccgtggcgccagcgtatgggaaggggccgtgaggaacgcttcagccatgttggcccaggtgcctctgctccccctgcatcccatccggagccaaagggagacatacaaaataatctccaggttggcttgggtgggtttcctttcctggaagaaacagcattctttggacagttagggtgagcagccctgagaggagttgctcgcgatacgccgtgttcctgcttctgcctgtccacctcccccggccagtgcatgcttgcttctcccagcccttggctgtctcatttagtgtctaaggctgagggtttattttcttgccccttaccgccccccatcctatatcttttaaggggtgtctaaaatttttcttactagtttttgtttttttctagagtctcactgtgtcactcaggctggggtgcaatggcataatcatagctcctcggctcatacaatcctgcctcggcctcctaagtagctgggactacaggtgtgggacaccatgcctggctaatttttaaatttgtattttgtagagacagggtcttgctgtgttgcccaggctggtctcaaactcctgggctcaagcagtcctcctgcctcagcctcccaagtagttaggaccacagacaagtgtcactacccctggctaatttttaaatgttccgtagaaactgggtctccctatgttgcccaggctggtctcaaactcctgggctcaaggtgtcctcctaactcggcctcccaaagtgttgggattacaggtgtgaggcaccgcacccagccggagtttgttaaatcattgtaagcgattatgttttctttgatttgtgccttgtgaaacatacataccctcttcaacaagagtcagtagaccttctagcattcactgggcatagcagaaaatagcaggtcatagtcagaaagtaagtgcttgccagttatgaaagtggccttatcagttaacaatatgaatatttcaggcgtacagagctgtggatatgggagaatggcagaagggataactctacccattcctagaaaagatttaggatatctttattttcttgatcctaaatgaaaagctctcatcaataaaatgccctgctgcctcttccgtaactgggctaatgttgaacaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgtgagtcttgcatgatctgtgttgtccagtaggacttattttagtaatggtttaatttgatgcacatcctcttctgtccacacgtccccagctgcatacacgccacacggcatggtcgtgtcaatgcctatccacagtggaaccacgaccgccgcccccaagagctatcaggcccacctggggaacctgtggcttgggtcctgccacccaccccagacctccttcctccatctcttgagagtcagtcgtacacagctaacccagcgctgagccaggtactgtctcttaggagccacagcaatagagaaatgacattttagacacaatttctcctcttattttacaccctgcctttgacccattttcggtatgaaaaggtcttgctgggaccagagcaggctgtggctaaagcagtaattctcaggtgtggagtaagagtagtagaccttttgctttgtgggtgttcagagaagtccctggaaccccaaaatactgttcaggcagtggctccctcagcattgtcagctgcgctgggcacagggtgggctgtgtctaagaccccggaaaccatcctgcctcttgttgggattccgagacaccagttgttctgtaaatttttaaatcgtttcaaactatgttttcagctgattttctttattcttatgcttttttaaaaggcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtaagctcaatccttcaggtgggtggcaaggaacagccccgtgctcagggaggggcaggcagtgtgtggtggggagttcctcacctggggctcgaagccctcagccaaggcattttataagccatatgctctgaggcgtccccagtacagtccacatggggtcatttttttgcatggaggagatggtgagggtgcataacaaatgtcaaaaatcacttttggaaagattagttatttggtttcaattctgatatgaaaacaagccccttgacattggggcggaggaaaagagaaagtgtggcagtcagttacctccgaacacacacatctggcgctcgtgagactccgctttcagaagcacctcagtgggtgcgtttgcatgggatggccttgcagttgcttgaagctgtgattaaatcccctttcaagagtgtcccgccaccaattagttattggcagctgatagtcaaccaaataggaaaacgctgtatgtgtttgattcctgatagcttttcctgtttctaccgtcttcttaggtcggatgctttgggacagattctcccacagctgggcaaagactggacccaccagggtatagcaaagctctaccattccatcaatgagtaggtaccctccccacgttaactcgctctggtgagctggaagcttgctttaagaactatagaacaatggtgtaagtcttcagtccacatgagtcatgtgtttatgctgaagcattcccgctcttcctcactcctttcctgttgatggtgtgggagccgtgtgcacctggcattggcatcgaacctgtgtcatctcagttaatcctcacagtgctgtgtttcaggcactacctacatctataactagaatgacagttatttttttagctagaatttaataagatagctgattttcatttttggtttattttctgggtattttaaatttttttttttttttttttttttttttttgagatggagttttgctcttgtcgcccaggctgaagtgcaatggcgcgaccttggctcactgcagtctccgcctcccgggttcaagtgattcttctgcctcagtctcccgagtagctgggattaccggcacatgccaccatgcccagctaattttgtatttttagtacagatggggtttcatcatgttggtcaggctggtcttgaactccgaacctcaggtgatctccccgcctcggcctcccaaagtgctgggattacaggcatgagctattgcgcccagccttaaaattgtatttctttgagtagatagtgcacgcatgcatgagggaaatagttcttgcatgggctgctctctcttggggcaccctttgaggggaagatagccgtgccatggcgtttgtgggttcctaatacatatattacattgatctgaagaatctcagtgtcttcagcattagttgagaataccataatatgaaaattacgaatatgtcagttacctgggtataattttgcttcttgtctgatggagtggtttgcatcttgcacattgcctttataaataatatcccctatattttttcttcacagtgggtaatttaaagatagtccaaggttttttctgtcctctaatctggctttcatggactagatgctgaacattttatatcagtacttacaaacttaacataatccttagttgcctgtacctccatttttttcccacgttttccatggaaggtgaaacctctataatcctaagcagtttcctgctaaatttgagaatttggttttcacagtaaatgagaggaagtttatttggatcttttaaaagaaaagtatgggttgagcatggtggctcacacctgtaatcccagcactttgggaggctgaggtgggcaggttgcctgaggttaggagcttaagaccaatctagccaacatggtgaaaccctgtctctactaaaaaatataaaaattaagccgggcatggtgtcccatgcctgtaatcctagctacttgggaggctgaggcaggagaattgcttgaatccaggaggtggaggttgcagtgagccgagatggcgccacagcactccagcctgggtaacagagtgagactcaaaaaaaaaagaaagaaaagtgtggggttttttttttgttttttgttttcttttcccttagccagaacatgtgggctaacagggtgtgttttctttcaggaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacaggtacctctccggcaggcagccctctgcccaccgccccagcatgtgggcggggctgggcccaaggtggggggatgtgtgggaacagaagtcagatgttggagccgccacgcctctcccagttctttggtccctggtggtgtcctaccacatactgctcacttgccatgtggcgggcctggtgaagaaaggcaggttctaggaaccgtcaagttttctccttccctaaacttcatcactcaaattttcttagttatcagactggcaaagaaggagaaggaaagattccagttacaaagggttgaagaaattgggtggttgtgagcactaaaattttaggaccactcactggggaaaacgaccattttgagattggtgattgtatttgtatttttttcttagagaagtgatagaaaagaaaccagagaagttcaaaattgagtgtctaaatgatatcaagaatctgtttgccccgtctaagcagcccttctatgctgcctttggaaaccgtccaaatgtgagtatctcctgggctctgggttctgatgtgggtgaaattcagagggatgtacttcgtggggtgtagccacgtcccaattctcaaagcagttttgtaagcaaaatgaggcatctgttctgcttgttcggttttcacttgatctattccaaatatctatagcaactggggaggtcctgcaggtgcagatctgccccagaatttatacgaaggacgcttttccatcgtttctgtggctgccattccatttcctcaggcagctccggctcctcttctaagcagttctgagctgcgtccttggatcaccccagagccagggtcagtgctggcccttcgctagcacttcccaacctgcctcccttctgcagggccatcgggcctcaggtgtgcagaagatgtggcctctctggcctcttctgcgccagggaccctggcttccccttggtggctgcccaagttttctgactctccaagcaccactctgtagtttaggtttgtctaaagctcagttttggtggcaactgcactgtgccgcctccgcatgttttctgtcgagtctgtctgtgcagtgcttctggctcacaaggagcctgagaagtatctcctgaattctcctccctggaatcacccgcttgctattttcttctgcaggatgtctatgcctacacacaagttggagttccagactgtagaatattcaccgtgaaccccaagggtgaattaatacaagaaagaaccaaaggaaacaagtcatcgtaagtacattctcagctctcagcccggcgccctgcagccaggggtacagttggggacagacagaccctgtccttttccccctgatccttgagatcaggccctgatcaaaggatcagctacatctcctctgtgggtatctctctttcacaatatctgtttgaggggtctctggttatcctagacttgtaagagggagtttgagccctgtgatgggactgaggcctgcctctgaacctgcccacctgagcaatctgagtgacagcttcacagccccccatcttgtgcctttgaccgatcttgaagtaatagcctgtgcctcttccccaacctttctcttaggtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaatttcgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaa
